US010590436B2

United States Patent
Meijrink et al.

(10) Patent No.: US 10,590,436 B2
(45) Date of Patent: *Mar. 17, 2020

(54) CRISPR-CAS SYSTEM FOR A LIPOLYTIC YEAST HOST CELL

(71) Applicant: DSM IP ASSETS B.V., Heerlen (NL)

(72) Inventors: Bernard Meijrink, Echt (NL); René Verwaal, Echt (NL); Bianca Elisabeth Maria Gielesen, Echt (NL); Johannes Andries Roubos, Echt (NL)

(73) Assignee: DSM IP ASSETS B.V., Heerlen (NL)

( * ) Notice: Subject to any disclaimer, the term of this patent is extended or adjusted under 35 U.S.C. 154(b) by 0 days.

This patent is subject to a terminal disclaimer.

(21) Appl. No.: 15/541,288

(22) PCT Filed: Jan. 6, 2016

(86) PCT No.: PCT/EP2016/050135
§ 371 (c)(1),
(2) Date: Jun. 30, 2017

(87) PCT Pub. No.: WO2016/110511
PCT Pub. Date: Jul. 14, 2016

(65) Prior Publication Data
US 2018/0023096 A1    Jan. 25, 2018

Related U.S. Application Data

(60) Provisional application No. 62/177,497, filed on Mar. 16, 2015.

(30) Foreign Application Priority Data

Jan. 6, 2015 (EP) ..................................... 15150135
Jan. 6, 2015 (EP) ..................................... 15150148

(51) Int. Cl.
| | | |
|---|---|---|
| C12P 19/34 | (2006.01) | |
| C12N 15/64 | (2006.01) | |
| C07H 21/02 | (2006.01) | |
| C12N 15/90 | (2006.01) | |
| C12N 15/63 | (2006.01) | |
| C12N 9/22 | (2006.01) | |
| C12N 15/11 | (2006.01) | |

(52) U.S. Cl.
CPC ............. *C12N 15/905* (2013.01); *C12N 9/22* (2013.01); *C12N 15/11* (2013.01); *C12N 15/63* (2013.01); *C12N 2310/20* (2017.05)

(58) Field of Classification Search
CPC ........ A61K 38/00; C07K 16/30; C12N 15/10; C12N 15/86; C12N 15/81
See application file for complete search history.

(56) References Cited

U.S. PATENT DOCUMENTS

2018/0010151 A1* 1/2018 Verwaal ............... C12N 15/102

OTHER PUBLICATIONS

Ryan et al., eLife, 2014; 3: 1-15.*
Hoppner (Horm Re. 2002, 58 Suppl. 3:7-15) (Year: 2002).*
Ryan, et al., "Multiplex Engineering of Industrial Yeast Genomes Using CRISPRm," Methods in Enzymology, (2014) vol. 546: 473-489.
Bao, et al., "Homology-Integrated CRISPR-Cas (HI-CRISPR) System for One-Step Multigene Disruption in *Saccharomyces cerevisiae*," ACS Synthetic Biology (2014).
Madzak, et al., "Heterologous protein expression and secretion in the non-conventional yeast *Yarrowia lipolytica*: a review," Journal of Biotechnology, (2004) vol. 109: 63-81.
Zhang, et al., "Construction of a Quadruple Auxotrophic Mutant of an Industrial Polyploid *Saccharomyces cerevisiae* Strain by Using RNA-Guided Cas9 Nuclease," Applied and Environmental Microbiology, (2014) vol. 80, No. 24: 1694-7701.
Dicarlo, et al., "Genome engineering in *Saccharomyces cerevisiae* using CRISPR-Cas systems," Nucleic Acids Research, (2013) vol. 41, No. 7: 4336-4343.
Xu, et al., "Efficient genome engineering in eukaryotes using Cas9 from *Streptococcus thermophilus*," Cell. Mol. Life Sci., (2015) vol. 72: 383-399.
Cencic, et al., "Protospacer Adjacent Motif (PAM)-Distal Sequences Engage CRISPR Cas9 DNA Target Cleavage," Plos One, (2014) vol. 9, Issue 10: 1-13.
Ryan, et al., "Selection of chromosomal DNA libraries using a multiplex CRISPR system," eLife (2014), vol. 3:e03703.
Vernis, et al., "Only Centromeres Can Supply the Partition System Required for ARS Function in the Yeast *Yarrowia lipolybca*," J. Mol. Biol., (2013) vol. 305: 203-217.
Gao, et al., "Self-processing of ribozyme-flanked RNAs into guide RNAs in vitro and in vivo for CRISPR-mediated genome editing," Journal of Integrative Plant Biology, (2014) vol. 56, Issue 4: 343-349.
Sakai, et al., "High-Frequency Transformation of a Methylotrophic Yeast, *Candida boidinii*, with Autonomously Replicating Plasmids Which Are Also Functional in *Saccharomyces cerevisiae*," Journal of Bacteriology, (1993) vol. 175, No. 31: 3556-3562, No. 11.

* cited by examiner

*Primary Examiner* — Gary B Nickol
*Assistant Examiner* — Lakia J Jackson-Tongue
(74) *Attorney, Agent, or Firm* — McBee Moore & Vanik IP, LLC

(57) ABSTRACT

The present invention relates to the field of molecular biology and cell biology. More specifically, the present invention relates to a CRISPR-CAS system for a lipolytic yeast host cell.

19 Claims, 5 Drawing Sheets
Specification includes a Sequence Listing.

Fig. 3

→ = strain with brown phenotype    ⇢ = growth on MM-agar -> no mutation

Fig. 5

CRISPR-CAS SYSTEM FOR A LIPOLYTIC YEAST HOST CELL

CROSS-REFERENCE TO RELATED APPLICATIONS

This application is a National Stage entry of International Application No. PCT/EP2016/050135 filed 6 Jan. 2016, which claims priority to European Patent Application No. 15150135.0, filed 6 Jan. 2015, European Patent Application No. 15150148.3, filed 6 Jan. 2015, and U.S. Patent Application No. 62/177497, filed 16 Mar. 2015.

REFERENCE TO SEQUENCE LISTING SUBMITTED AS A COMPLIANT ASCII TEXT FILE (.txt)

Pursuant to the EFS-Web legal framework and 37 CFR §§ 1.821-825 (see MPEP § 2442.03(a)), a Sequence Listing in the form of an ASCII-compliant text file (entitled "Sequence_Listing_2919208-313002_ST25.txt" created on 14 Jun. 2017, and 26,777,693 bytes in size) is submitted concurrently with the instant application, and the entire contents of the Sequence Listing are incorporated herein by reference.

FIELD OF THE INVENTION

The present invention relates to the field of molecular biology and cell biology. More specifically, the present invention relates to a CRISPR-CAS system for a lipolytic yeast host cell.

BACKGROUND TO THE INVENTION

Recent advances in genomics techniques and analysis methods have significantly accelerated the ability to e.g. catalog and map genetic factors associated with a diverse range of biological functions and diseases. Precise genome engineering technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors nucleases (TALENs), or homing meganucleases are available for producing targeted genome perturbations, there remains a need for new genome engineering technologies that are affordable, easy to set up, scalable, and amenable to targeting multiple positions within a genome. The engineering of meganucleases has been challenging for most academic researchers because the DNA recognition and cleavage functions of these enzymes are intertwined in a single domain. Robust construction of engineered zinc finger arrays has also proven to be difficult for many laboratories because of the need to account for context-dependent effects between individual finger domains in an array. There thus exists a pressing need for alternative and robust techniques for targeting of specific sequences within a host cell with a wide array of applications.

SUMMARY OF THE INVENTION

The present invention addresses above described need and provides such technique. The present invention is based on the CRISPR-Cas system, which does not require the generation of customized proteins to target-specific sequences but rather a single Cas enzyme that can be programmed by a guide-polynucleotide to recognize a specific polynucleotide target; in other words, the Cas enzyme can be recruited to a specific polynucleotide target using said guide-polynucleotide molecule. Adding the CRISPR-Cas system to the repertoire of genomics techniques and analysis methods may significantly simplify existing methodologies in the field of molecular biology.

The present invention provides a non-naturally occurring or engineered composition comprising a source of a CRISPR-Cas system comprising a guide-polynucleotide and a Cas protein, wherein the guide-polynucleotide comprises a sequence that essentially is the reverse complement of a target-polynucleotide in a host cell and the guide-polynucleotide can direct binding of the Cas protein at the target-polynucleotide in the host cell to form a CRISPR-Cas complex.

The present invention further relates to a method of modulating expression of a polynucleotide in a cell, comprising contacting a host cell with the composition according to the present invention, wherein the guide-polynucleotide directs binding of the Cas protein at the target-polynucleotide in the host cell to form a CRISPR-Cas complex.

The present invention further relates to a host cell comprising a composition according to the present invention.

The present invention further relates to a method of producing a host cell, comprising contacting a host cell with the composition according to the present invention, wherein the guide-polynucleotide directs binding of the Cas protein at the target-polynucleotide in the host cell to form a CRISPR-Cas complex.

The present invention further relates to a method for the production of a compound of interest, comprising culturing under conditions conducive to the compound of interest a host cell according to the present invention and optionally purifying or isolating the compound of interest.

BRIEF DESCRIPTION OF THE DRAWINGS

FIG. 3 depicts the results of example 10; sequencing of mutants obtained is shown in (SEQ ID NO: 92).

DESCRIPTION OF THE SEQUENCE LISTING

Figure 1:
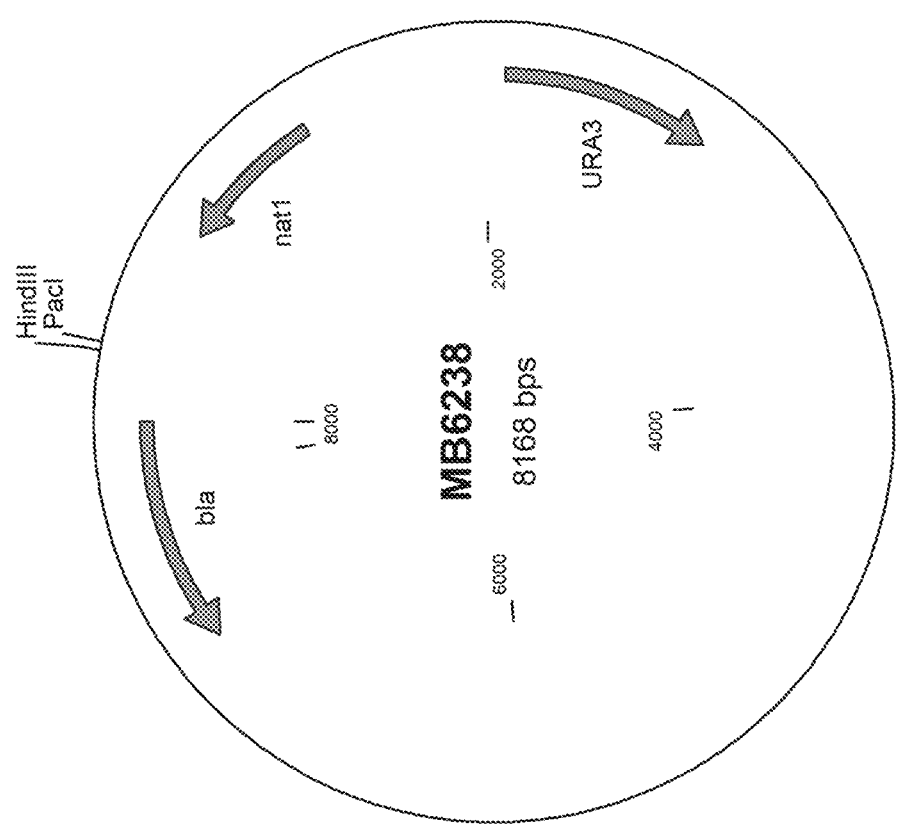
FIG. 1 depicts vector MB6238, containing a URA3 marker and CEN/ARS sequence for *S. cerevisiae, E. coli* ori and an Ampicillin resistance marker for *E. coli*.

SEQ ID NO: 1-3 empty.
SEQ ID NO: 4 sets out the genome of *Yarrowia lipolytica* CLIB122.
SEQ ID NO: 5-68 empty.
SEQ ID NO: 95-124 empty.
Sequences in examples 1-10
SEQ ID NO: 69 sets out the promoter fragment YI-PRO28 functional in *Yarrowia lipolytica*.
SEQ ID NO: 70 sets out the coding sequence of CAS9
SEQ ID NO: 71 sets out the terminator sequence YI-ter02
SEQ ID NO: 72 sets out the backbone vector 5a
SEQ ID NO: 73 sets out resulting vector BG-C1
SEQ ID NO: 74 sets out the promoter fragment YI-PRO07
SEQ ID NO: 75 sets out gRSR
SEQ ID NO: 76 sets out the terminator sequence YI-ter04
SEQ ID NO: 77 sets out the backbone vector ab
SEQ ID NO: 78 sets out resulting vector BG-C4

SEQ ID NO: 79 sets out forward primer DBC-12192
SEQ ID NO: 80 sets out reverse primer DBC-05794
SEQ ID NO: 81 sets out forward primer DBC-05795
SEQ ID NO: 82 sets out reverse primer DBC-12194
SEQ ID NO: 83 sets receiving vector MB6238
SEQ ID NO: 84 sets out the gBlock donor DNA
SEQ ID NO: 85 sets out forward primer gBlock DBC-12197
SEQ ID NO: 86 sets out reverse primer gBlock DBC-12198
SEQ ID NO: 87 sets out the Hygromycin marker cassette
SEQ ID NO: 88 sets out forward primer DBC-05799
SEQ ID NO: 89 sets out reverse primer DBC-05800
SEQ ID NO: 90 sets out forward primer in front ade33 DBC-12607
SEQ ID NO: 91 sets out the wild-type ADE33 sequence
SEQ ID NO: 92 sets out the mutated ADE33 sequence
SEQ ID NO: 93 sets out forward primer DBC-05793
SEQ ID NO: 94 sets out reverse primer DBC-05796

DETAILED DESCRIPTION OF A PREFERRED EMBODIMENT

In a first aspect, the present invention provides a non-naturally occurring or engineered composition comprising a source of a CRISPR-Cas system comprising a guide-polynucleotide and a Cas protein, wherein the guide-polynucleotide comprises a guide-sequence that essentially is the reverse complement of a target-polynucleotide in a host cell and the guide-polynucleotide can direct binding of the Cas protein at the target-polynucleotide in the host cell to form a CRISPR-Cas complex, wherein the guide-sequence is essentially the reverse complement of the (N)y part of a 5'-(N)yPAM-3' polynucleotide sequence target in the genome of the host cell, wherein y is an integer of 8-30, more preferably 10-30, more preferably 15-30, more preferably 17-27, more preferably 17-20, more preferably 17, 18, 19, 20, 21, 22, 23, 24, 25, 26, or 27, wherein PAM is a protospacer adjacent motif, wherein the host cell is a lipolytic yeast, preferably a *Yarrowia*, more preferably a *Yarrowia lipolytica*, even more preferably *Yarrowia lipolytica* CL1B122 or *Yarrowia lipolytica* ML324 (deposited under number ATCC18943), and wherein PAM is preferably a sequence selected from the group consisting of 5'-XGG-3', 5'-XGGXG-3', 5'-XXAGAAW-3', 5'-XXXX-GATT-3', 5'-XXAGAA-3', 5'-XAAAAC-3', wherein X can be any nucleotide or analog thereof, preferably X can be any nucleotide; and W is A or T.

A preferred genome of *Yarrowia* is the genome represented by SEQ ID NO: 4. Unknown or ambiguous nucleotides in a genome (such as a nucleotide depicted with "n") are preferably excluded as polynucleotide sequence target.

The composition, source, CRISPR-Cas system, guide-polynucleotide, Cas protein, target-polynucleotide, host cell and CRISPR-Cas complex are herein referred to as a composition, source, CRISPR-Cas system, guide-polynucleotide, Cas protein, target-polynucleotide, host cell and CRISPR-Cas complex according to the present invention. For the sake of completeness, since "a" is defined elsewhere herein as "at least one", a composition according to the present invention comprises a source of at least one, i.e. one, two, three or more guide-polynucleotides and/or at least one, i.e. one, two, three or more Cas proteins. Accordingly, the present invention conveniently provides for a multiplex CRISPR-Cas system. Such multiplex CRISPR-Cas system can conveniently be used for introduction of a donor polynucleotide, deletion of a polynucleotide and polynucleotide library insertion into the genome of a host cell. Herein, a multiplex CRISPR-Cas system may refer to the use of one of more Cas proteins, one of more guide-polynucleotides and/or one or more donor polynucleotides. Herein, when a combination of a single guide-polynucleotide and multiple donor polynucleotides is used wherein the donor polynucleotides are configured such that they will be introduced into a single target locus, the term "singleplex" is used.

The terms "CRISPR system", "CRISPR-Cas system" and "CRISPR enzyme system" are used interchangeably herein and refer in the context of all embodiments of the present invention to a collection of elements required to form, together with a target-polynucleotide, a CRISPR-Cas complex; these elements comprise but are not limited to a Cas protein and a guide-polynucleotide.

The term "CRISPR-Cas complex" refers in the context of all embodiments of the present invention to a complex comprising a guide-polynucleotide hybridized to a target-polynucleotide and complexed with a Cas protein. In the most straightforward form, where a non-mutated Cas protein is used such as but not limited to the Cas9 protein of *Streptococcus pyogenes*, the formation of the CRISPR-Cas complex results in cleavage of one or both polynucleotide strands in or near (e.g. within 1, 2, 3, 4, 5, 6, 7, 8, 9, 10, 20, 50, or more base pairs from) the target-polynucleotide. Typically, a target-polynucleotide according to the present invention (defined below herein) is associated with a PAM sequence (defined below herein) and the PAM sequence is preferably immediately downstream (3') of the target-polynucleotide; the formation of the CRISPR-Cas complex typically results in cleavage of one or both polynucleotide strands 3 base pairs upstream (5') of the PAM sequence.

The term "non-naturally occurring composition" refers in the context of all embodiments of the present invention to a composition that in its form used in the present invention does not occur in nature. The individual elements may e.g. occur as such or in combinations with other elements in nature, but the non-naturally occurring composition comprises e.g. at least one element more or less than a naturally composition.

The term "engineered composition" refers in the context of all embodiments of the present invention to a composition wherein at least one of the elements has been engineered, i.e. modified by man, in such a way that resulting element does not occur in nature. It follows that by virtue of comprising at least one engineered element, an engineered composition does not occur in nature.

The terms "polynucleotide", "nucleotide sequence" and "nucleic acid" are used interchangeably herein and refer in the context of all embodiments of the present invention to a polymeric form of nucleotides of any length, either deoxyribonucleotides or ribonucleotides, or mixes or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, oligonucleotides and primers. A polynucleotide may comprise one or more modified nucleotides, such as a methylated nucleotide and a nucleotide analogue or nucleotide equivalent wherein a nucleotide analogue or equivalent is defined as a residue having a modified base, and/or a modified backbone, and/or a non-natural internucleoside linkage, or a combination of these modifications. Preferred nucleotide analogues and equivalents are described in the section "General definitions". As desired, modifications to the nucleotide structure may be introduced before or after assembly of the polynucleotide. A polynucleotide may be further modified after polymerization, such as by conjugation with a labeling compound.

A guide-polynucleotide according to the present invention comprises at least a guide-sequence that is able to hybridize with the target-polynucleotide and is able to direct sequence-specific binding of the CRISPR-Cas system to the target-polynucleotide to form a CRISPR-Cas complex. In order to enable formation of an active CRISPR-Cas complex, the guide-polynucleotide preferably also comprises a sequence that has a specific secondary structure and allows binding of the Cas protein to the guide-polynucleotide. Such sequence is known in the art as tracrRNA, tracr sequence, tracr scaffold or guide-polynucleotide structural component, these terms are used interchangeably herein; wherein the tracr is the abbreviation for transactivating CRISPR; tracr-RNA thus means transactivating CRISPR RNA. The tracr-RNA in the original CRISPR-Cas system is the endogenous bacterial RNA that links the crRNA (guide-sequence) to the Cas nuclease, being able to bind any crRNA. A guide-polynucleotide structural component may be comprised of a single polynucleotide molecule or may be comprised of two or more molecules hybridized to each other; such hybridizing components of a guide-polynucleotide structural component may be referred to as a tracr sequence and a tracr-mate sequence.

Accordingly, the guide-polynucleotide preferably also comprises a tracr sequence and/or a tracr-mate sequence. The guide-polynucleotide is a polynucleotide according to the general definition of a polynucleotide set out here above; a preferred guide-polynucleotide comprises ribonucleotides, a more preferred guide-polynucleotide is a RNA (guide-RNA). Two examples of typical guide-polynucleotide structures are depicted in Sander and Joung, 2014.

In the context of the present invention, a sequence is referred to as essentially the reverse complement of a target-sequence or of a target-polynucleotide if the subject sequence is able to hybridize with the target-sequence or target-polynucleotide, preferably under physiological conditions as in a host cell. The degree of complementarity between a guide-sequence and its corresponding target-sequence, when optimally aligned using a suitable alignment algorithm, is preferably higher than 50%, 60%, 75%, 80%, 85%, 90%, 95%, 97.5%, 99% sequence identity. Optimal alignment may be determined using any suitable algorithm for aligning sequences, preferably an algorithm as defined herein under "Sequence identity". When the target-polynucleotide is a double stranded polynucleotide, the subject sequence, such as a guide-sequence, may be able to hybridize with either strand of the target-polynucleotide e.g. a coding strand or a non-coding strand.

Preferably, a guide-sequence according to the present invention targets a target-sequence that is unique in the target. Preferably, a guide-sequence according to the present invention has 100% sequence identity with the 8, 9, 10, 11, 12, 13, 14, 15, 16, 17, 18, 19 or 20, more preferably 8, 9, 10, 11 or 12 nucleotides in the target-polynucleotide immediately adjacent to a PAM sequence.

A guide-sequence according to the present invention preferably is 8-30, more preferably 10-30, more preferably 15-30, more preferably 17-27, more preferably 17-20, more preferably 17, 18, 19, 20, 21, 22, 23, 24, 25, 26, or 27 nucleotides in length. The ability of a guide-sequence to direct sequence-specific binding of a CRISPR-Cas system to a target-sequence to form a CRISPR-Cas complex may be assessed by any suitable assay. For example, the components of a CRISPR system sufficient to form a CRISPR-Cas complex, including the guide-sequence to be tested, may be provided to a host cell having the corresponding target-sequence, such, as by transfection with vectors encoding the components of the CRISPR-Cas system, followed by an assessment of preferential cleavage within the target-sequence, such as by the Surveyor assay (Surveyor® Mutation Detection Kits distributed by Integrated DNA Technologies, Leuven, Belgium) or another sequence analysis assay such as sequencing. Cleavage of a target-polynucleotide may be evaluated in a test tube by providing the target-polynucleotide, components of a CRISPR-Cas system, including the guide-sequence to be tested and a control guide-sequence different from the test guide-sequence, and comparing binding or rate of cleavage at the target-sequence between the test and control guide-sequence reactions. Other assays are possible, and are known to a person skilled in the art.

A guide-polynucleotide structural component is believed to be necessary for formation of an active CRISPR-Cas complex. The guide-polynucleotide structural component is believed not necessarily to be operably linked to the guide-sequence; however, a guide-polynucleotide structural component may be operably linked to a guide-sequence within a guide-polynucleotide. A guide-polynucleotide structural component according to the present invention, which may comprise or consist of all or a portion of a wild-type guide-polynucleotide structural component (e.g. about or more than about 20, 26, 32, 45, 48, 54, 63, 67, 85, or more nucleotides of a wild-type tracr-sequence) forms part of a CRISPR-Cas complex; e.g. by hybridization of at least a portion of a tracr-sequence according to the present invention to all or a portion of a tracr-mate sequence according to the present invention and preferably operably linked to a guide-sequence according to the present invention. A tracr-sequence according to the present invention has sufficient complementarity to a tracr-mate sequence according to the present invention to hybridize, preferably under physiological condition as in a host cell, and facilitate formation of a CRISPR-Cas complex. As with the target-sequence according to the present invention, it is believed that complete complementarity is not needed, provided there is sufficient complementarity to be functional. Preferably, the tracr-sequence according to the present invention has at least 50%, 60%, 70%, 80%, 90%, 95% or 99% sequence identity along the length of the tracr-mate sequence according to the present invention when optimally aligned. Optimal alignment may be determined using any suitable algorithm for aligning sequences, preferably an algorithm as defined herein under "Sequence identity".

In general, a tracr mate sequence according to the present invention includes any sequence that has sufficient complementarity with a tracr sequence according to the present invention to promote formation of a CRISPR-Cas complex at a target-sequence, wherein the CRISPR-Cas complex comprises the tracr mate sequence according to the present invention hybridized to the tracr sequence according to the present invention. The degree of complementarity of the tracr sequence according to the present invention and the tracr mate sequence according to the present invention is preferably defined with respect to optimal alignment of the tracr mate sequence and tracr sequence along the length of the shorter of the two sequences. Optimal alignment may be determined using any suitable algorithm for aligning sequences, preferably an algorithm as defined herein under "Sequence identity".

Preferably, with respect to a tracr mate sequence according to the present invention and a tracr sequence according to the present invention, secondary structures are taken into account, such as self-complementarity within either the tracr sequence or tracr mate sequence. Preferably, the degree of complementarity between the tracr sequence according to the present invention and tracr mate sequence according to the present invention along the length of the shorter of the two sequences when optimally aligned is higher than 50%, 60%, 75%, 80%, 85%, 90%, 95%, 97.5%, 99% sequence identity. Preferably, the tracr mate sequence according to the present invention is 5, 6, 7, 8, 9, 10, 11, 12, 13, 14, 15, 16, 17, 18, 19, 20, 25, 30, 40, 50, or more nucleotides in length. Preferably, the tracer sequence according to the present invention is 5, 6, 7, 8, 9, 10, 11, 12, 13, 14, 15, 16, 17, 18, 19, 20, 25, 30, 40, 50, or more nucleotides in length. Preferably, the tracr sequence according to the present invention and tracr mate sequence, i.e. the guide-polynucleotide structural component according to the present invention are comprised within a single transcript, such that hybridization between the two produces a hybridization complex comprising a secondary structure, such as a hairpin. Such hybridization complex may also be formed when the tracr sequence and the tracr mate sequence are not comprised in a single transcript. Preferred loop forming sequences in a tracr sequence according to the present invention and/or a tracr mate sequence according to the present invention and/or guide-polynucleotide structural component according to the present invention for formation of hairpin structures are four nucleotides in length, and most preferably have the sequence GAAA; longer or shorter loop sequences may be used, as may alternative sequences. The loop sequences preferably include a nucleotide triplet (for example, AAA), and an additional nucleotide (for example C or G). Examples of loop forming sequences include CAAA and AAAG. Preferably, a tracr sequence according to the present invention and/or tracr mate sequence according to the present invention or hybridization complex thereof and/or guide-polynucleotide structural component according to the present invention comprises or is able to form at least two or more hairpins. More preferably, a tracr sequence according to the present invention and/or tracr mate sequence according to the present invention or hybridization complex thereof and/or guide-polynucleotide structural component according to the present invention comprises or is able to form two, three, four or five hairpins. Preferably, a tracr sequence according to the present invention and/or tracr mate sequence according to the present invention or hybridization complex thereof and/or guide-polynucleotide structural component according to the present invention comprises or is able to form at most five hairpins. Preferably, the single transcript of a tracr sequence according to the present invention and a tracr-mate sequence according to the present invention or hybridization complex of a tracr sequence according to the present invention and a tracr mate sequence according to the present invention and/or guide-polynucleotide structural component according to the present invention further comprises a transcription termination sequence; preferably this is a polyT sequence, for example six T nucleotides. As said, guide-polynucleotide structural components are known to the person skilled in the art; background information can e.g. be found in Gaj et al, 2013.

In the context of all embodiments according to the present invention, the term "target-polynucleotide" refers to a target-sequence according to the present invention to which a guide-sequence according to the present invention is designed to have complementarity, where hybridization between a target-sequence according to the present invention and a guide-sequence according to the present invention promotes the formation of a CRISPR-Cas complex. Full complementarity is not necessarily required, provided there is sufficient complementarity to cause hybridization and promote formation of a CRISPR-Cas complex. Preferably, a guide-sequence according to the present invention targets a target-sequence that is unique in the target. Preferably, a guide-sequence according to the present invention has 100% sequence identity with the 8, 9, 10, 11, 12, 13, 14, 15, 16, 17, 18, 19 or 20, more preferably 8, 9, 10, 11 or 12 nucleotides in the target-polynucleotide immediately adjacent to a PAM sequence. A target-polynucleotide according to the present invention may comprise any polynucleotide, such as DNA or RNA polynucleotides and may be single or double stranded. When the target-polynucleotide is a double strand polynucleotide, a guide-sequence according to the present invention, may be able to hybridize with either strand of the target-polynucleotide e.g. a coding strand or a non-coding strand.

A target-polynucleotide according to the present invention may be located in the nucleus or cytoplasm of a cell. A target-polynucleotide according to the present invention may be located in an organelle of a host cell, for example in a mitochondrion or chloroplast. A target-polynucleotide according to the present invention may be comprised in a genome, may be comprised in a chromosome or may be extra-chromosomal, may be comprised in an artificial chromosome such a Yeast Artificial Chromosome (YAC), may be present in any chromosomal entity or extra-chromosomal entity such as an autosomal replicating entity such as an episomal plasmid or vector. A target-polynucleotide according to the present invention may be native or foreign to the host cell.

A target-polynucleotide according to the present invention is preferably associated with a protospacer adjacent motif (PAM), which is a short polynucleotide recognized by the CRISPR-Cas complex. Preferably, the target-polynucleotide and PAM are linked wherein the PAM is preferably immediately downstream (3') of the target-polynucleotide. The exact sequence and length of the PAM may vary, e.g. different Cas proteins may require different PAM's. A preferred PAM according to the present invention is a polynucleotide of 2 to 8 nucleotides in length. A preferred PAM is selected from the group consisting of 5'-XGG-3', 5'-XG-GXG-3', 5'-XXAGAAW-3', 5'-XXXXGATT-3', 5'-XX-AGAA-3', 5'-XAAAAC-3', wherein X can be any nucleotide or analog thereof, preferably any nucleotide; and W is A or T. A more preferred PAM is 5'-XGG-3'. The PAM is preferably matched with the Cas protein. The most widely used CAS/CRISPR system is derived from *S. pyogenes* and the matching PAM sequence 5'-XGG-3' is located immediately downstream (3') of the target-sequence. A preferred PAM for a *Neisseria meningitidis* Cas protein is 5'-XXXXGATT-3'; a preferred PAM for a *Streptococcus thermophilus* Cas protein is 5'-XXAGAA-3'; a preferred PAM for a *Treponema denticola* is 5'-XAAAAC-3'. A preferred PAM matches the Cas protein used. A Cas protein according to the present invention may be engineered to match a different PAM than the native PAM matching the wild-type Cas protein. As such, the CRISPR-Cas system according to the present invention may be used for customized specific targeting.

The term "hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence-specific manner. The complex may comprise two strands forming a duplex structure, three or more strands forming a multi stranded complex, a single self-hybridizing strand, or any combination of these. A hybridization reaction may constitute a step in a more extensive process, such as the cleavage of a polynucleotide by an enzyme. Preferred hybridization conditions are physiological conditions as within a host cell according to the present invention.

The term "source" in the context of all embodiments of the present invention refers to any source of a CRISPR-Cas system comprising a guide-polynucleotide and a Cas protein. The guide-polynucleotide and Cas protein may be present in separate sources. In such case, the composition according to the present invention comprises a CRISPR-Cas system comprising a source of a guide-polynucleotide and a source of a Cas-protein. Any source means that the guide-polynucleotide and Cas protein may be present as such in a form that they can function within a CRISPR-Cas system. The guide-polynucleotide and/or the Cas-protein may be provided in its active forms and may e.g. be provided from an inactive form or from another entity. The guide-polynucleotide may e.g. be present on another polynucleotide or may be encoded by a polynucleotide that is transcribed to provide for the actual guide-polynucleotide. The Cas protein may be encoded by a polynucleotide (e.g. DNA or mRNA) that is transcribed and/or translated to provide the actual Cas protein. An encoding polynucleotide may be present in a nucleic acid construct as defined herein and/or in a vector as defined herein. Such nucleic acid construct and vector are herein referred to as a nucleic acid construct according to the present invention and a vector according to the present invention.

Preferably, in the composition according to the present invention, the Cas protein is encoded by a polynucleotide and/or the guide-polynucleotide is encoded by or present on a polynucleotide.

Preferably, in the composition according to the present invention, the Cas protein is encoded by a polynucleotide and/or the guide-polynucleotide is encoded by or present on another polynucleotide and the polynucleotide or polynucleotides are comprised in a vector.

Preferably, in a composition according to the invention, the guide-polynucleotide is encoded by a polynucleotide that is transcribed to provide for the actual guide-polynucleotide. Accordingly, in an embodiment, in the composition according to the invention, preferably, the guide polynucleotide is present in the form of a polynucleotide encoding for said guide-polynucleotide and the guide-polynucleotide is obtained upon transcription of said polynucleotide in the host cell.

Preferably, in a composition according to the invention, the polynucleotide encoding a guide-polynucleotide has sequence identity with a vector such that recombination of the polynucleotide encoding the guide-polynucleotide and said vector is facilitated, wherein the recombination preferably is in vivo recombination in the host cell and wherein the vector is preferably linear. Accordingly, in an embodiment, in the composition according to the invention, preferably, a polynucleotide encoding a guide-polynucleotide has one or more regions of sequence identity with a first vector to allow homologous recombination between the polynucleotide encoding the guide-polynucleotide and said first vector to yield a second vector comprising the polynucleotide encoding the guide polynucleotide, wherein the recombination preferably is in vivo recombination in the host cell and wherein the first vector is preferably a linear vector. The person skilled in the art knows how to provide a linear vector; it can e.g. be synthesized as such or can be provided by restriction enzyme digestion of a circular vector. It allows the design of several distinct polynucleotides encoding a guide-polynucleotide that have homology with the vector without having to clone each polynucleotide encoding a guide-polynucleotide into the vector.

Preferably, such composition according to the invention comprises at least two distinct polynucleotides each encoding a respective distinct guide-polynucleotide, wherein said at least two polynucleotides additionally comprise sequence identity with each other such that recombination of the polynucleotides encoding the distinct guide-polynucleotides and said vector is facilitated, wherein the recombination preferably is in vivo recombination in the host cell and wherein the vector is preferably a linear vector. Accordingly, in an embodiment, the composition according to the invention preferably comprises at least two distinct polynucleotides each encoding a respective distinct guide-polynucleotide, wherein said at least two polynucleotides additionally comprise sequence identity with each other to allow homologous recombination of the polynucleotides encoding the distinct guide-polynucleotides with each other and with said (first) vector to yield a second vector comprising said at least two polynucleotides encoding each a guide-polynucleotide, wherein the recombination preferably is in vivo recombination in the host cell and wherein the (first) vector is preferably a linear vector. In an embodiment, the guide-polynucleotides are preferably distinct in their sequence identity with the target-polynucleotide.

In a variant embodiment, the polynucleotide encoding a guide-polynucleotide does not have sequence identity with a vector or another polynucleotide encoding a guide-polynucleotide itself, but an additional polynucleotide is present in the composition according to the invention that facilitates assembly of the polynucleotide encoding a guide-polynucleotide into the vector and/or assembly of a complex of two distinct polynucleotides each encoding a respective distinct guide-polynucleotide.

Accordingly, there is provided a composition according to the invention, wherein an additional set of polynucleotides is present that has sequence identity with a polynucleotide encoding a guide-polynucleotide and with a vector such that recombination of the polynucleotide encoding the guide-polynucleotide and said vector is facilitated, wherein the recombination preferably is in vivo recombination in the host cell and wherein the vector is preferably linear. In addition, there is provided a composition according to the invention, wherein a further polynucleotide is present that has sequence identity with a polynucleotide encoding the guide-polynucleotide and with a further and distinct polynucleotide encoding a further and distinct guide-polynucleotide such that recombination of the polynucleotides encoding the guide-polynucleotides and said vector is facilitated, wherein the recombination preferably is in vivo recombination in the host cell and wherein the vector is preferably linear.

Preferably, in the composition according to the present invention, the Cas protein is encoded by a polynucleotide and the guide-polynucleotide is encoded by or present on another polynucleotide and the polynucleotides are comprised in one vector.

Preferably, in the composition according to the present invention, the Cas protein is encoded by a polynucleotide comprised in a vector and the guide-polynucleotide is encoded by or present on another polynucleotide comprised in another vector. Preferably, the vector encoding the Cas protein is a low copy vector and the vector encoding the guide-polynucleotide is a high copy vector. This allows differential expression of the Cas protein and the guide-polynucleotide; the Cas protein may e.g. be expressed in lower level than the guide-polynucleotide. Preferably herein, a low copy vector is a vector that is present in an amount of at most 10, 9, 8, 7, 6, 5, 4, 3, 2 or most preferably 1 copy per host cell. Preferably herein, a high copy vector is a vector that is present in an amount of more than 10, at least 15, at least 20, 25, 30, 35, 40, 45, 50, 55, 60, 70, 80, 90, or at least 100 copies per host cell. Examples of low copy vectors are yeast replicating plasmids or yeast centromeric plasmids. An example of a high copy vector is a yeast episomal plasmid comprising the 2μ (also known as 2mu or 2 micron) origin of replication.

The invention thus provides for the possibilities that the guide-polynucleotide and the Cas protein are provided as such, or that they are encoded on or present on a vector. In the latter case, the encoding polynucleotides may each be on a separate vector or may both be on a single vector. The present invention, as depicted elsewhere herein, also provides for an exogenous polynucleotide, also referred to as a donor polynucleotide, a donor DNA when the polynucleotide is a DNA, or repair template, that upon cleavage of the target-polynucleotide by the CRISPR-Cas complex recombines with the target-polynucleotide, resulting in a modified target-polynucleotide. Such exogenous polynucleotide is herein referred to as an exogenous polynucleotide according to the present invention and may be single-stranded or double-stranded. Accordingly, a composition according to the present invention may further comprise an exogenous polynucleotide according to the present invention; a composition according to the invention may comprise one or more distinct exogenous polynucleotides. Such one or more distinct exogenous polynucleotides may encode different expression products or may encode identical expression products while a part of the exogenous polynucleotide has sequence identity to a part of the target-polynucleotide. In an embodiment, the composition according to the invention comprises one or more distinct exogenous polynucleotides, said exogenous polynucleotide comprise one or more regions of sequence identity to the target polynucleotide to allow, upon cleavage of the target-polynucleotide by the CRISPR-Cas complex, homologous recombination with the cleaved target-polynucleotide, resulting in a modified target-polynucleotide. Such compositions according to the invention allow for a multiplex CAS-CRISPR system according to the invention as referred to elsewhere herein. In an embodiment, in a composition according to the invention where at least two distinct exogenous polynucleotides are present that upon cleavage of the target-polynucleotide by the CRISPR-Cas complex recombine with the target-polynucleotides, resulting in a modified target-polynucleotide, said at least two distinct exogenous polynucleotides may comprise sequence identity with each other such that recombination of said distinct exogenous polynucleotides is facilitated, wherein the recombination preferably is in vivo recombination in the host cell. In an embodiment, the composition according to the invention comprising at least two distinct exogenous polynucleotides, each of said at least two distinct exogenous polynucleotides comprise at least one region of sequence identity with another exogenous polynucleotide and optionally with the target polynucleotide, to allow upon cleavage of the target-polynucleotide by the CRISPR-Cas complex, homologous recombination of said at least two distinct exogenous polynucleotides with one another and with the cleaved target-polynucleotide, resulting in a modified target-polynucleotide, wherein the recombination preferably is in vivo recombination in the host cell. Such compositions according to the invention allow for a singleplex CRISPR-Cas system according to the invention as described elsewhere herein. In a variant embodiment, an additional polynucleotide is present that has sequence identity with the exogenous and distinct polynucleotides such that recombination of the exogenous and distinct polynucleotides is facilitated, and wherein the recombination preferably is in vivo recombination in the host cell. In this variant embodiment, the additional polynucleotide or polynucleotides may have sequence identity with only the exogenous polynucleotides such that a complex of these can be formed. Alternatively, or in combination, an additional polynucleotide or polynucleotides may have sequence identity with an exogenous polynucleotide as well as sequence identity to a part of the target-polynucleotide such that the exogenous polynucleotide or complex of exogenous polynucleotides can be introduced into the target polynucleotide. The exogenous polynucleotide according to the present invention may be present on a vector or may be present as such, may be encoded by another polynucleotide or may be operably linked to the guide-polynucleotide and may have sequence identity to a part of the target-polynucleotide upstream of the PAM associated with the guide-sequence (i.e. on the 5' side of the PAM) or may have sequence identity to a part of the target-polynucleotide downstream of the PAM associated with the guide-sequence (i.e. on the 5' side of the PAM). The vector may be a separate vector for the exogenous polynucleotide. A vector carrying an exogenous polynucleotide may be any vector described herein below. The exogenous polynucleotide may be present on a vector that comprises a polynucleotide encoding a Cas protein according to the present invention and/or comprising a guide-polynucleotide or a polynucleotide encoding a guide-polynucleotide according to the present invention. Accordingly, in an embodiment, the present invention provides for a composition according to the present invention wherein a polynucleotide encoding a Cas protein according to the present invention, a guide-polynucleotide or a polynucleotide encoding a guide-polynucleotide according to the present invention are present on a single vector, which may further comprise any elements necessary for expressing the encoded products such as promoter and terminator elements. Such single (all-in-one) vector has the advantage that all components necessary for a CRISPR-Cas system are present together; in addition, a single transformation event, optionally in combination with a donor polynucleotide, suffices to introduce the components into a host cell. In an embodiment, there is provided a composition according to the present invention wherein a Cas protein according to the present invention is encoded by a polynucleotide which is present on a vector and a guide-polynucleotide according to the present invention is present as such (e.g. as a PCR fragment, a restriction fragment or a synthetic fragment), the guide-polynucleotide may be operably linked to an exogenous polynucleotide according to the present invention, wherein the guide-polynucleotide and/or the operably linked exogenous polynucleotide has sequence identity with the vector such that it allows in vivo recombination in the host cell of the guide-polynucleotide and/or the operably linked exogenous polynucleotide with the vector. Preferably, the in vivo recombination yields a second vector comprising the guide-polynucleotide and/or the operably linked exogenous polynucleotide. In case a guide-polynucleotide and an exogenous polynucleotide are operably linked and the guide-polynucleotide has sequence identity with the vector such as described here above, the exogenous polynucleotide is liberated when the guide-polynucleotide recombined with the vector. For the purposes described here above, the vector may be digested with a proper restriction enzyme (such as SapI) such that in vivo recombination is facilitated between the digested vector and the guide-polynucleotide and/or the operably linked exogenous polynucleotide. This embodiment enhances efficiency since it obviates the need for a vector-insert assembly step. These embodiments envisage that multiple distinct guide-polynucleotides can be used, or multiple distinct guide-polynucleotides operably linked to multiple distinct exogenous polynucleotides can be used, i.e. a library of guide-polynucleotides or guide-polynucleotides operably linked to multiple distinct exogenous polynucleotides. Such multiplex CRISPR-Cas system can conveniently be used for introduction of a donor polynucleotide sequence, deletion of a polynucleotide and polynucleotide library insertion into the genome of a host cell.

In the context of all embodiments of the present invention, a vector may be any vector (e.g., a plasmid or virus), which can conveniently be subjected to recombinant DNA procedures and can mediate expression of a polynucleotide according to the invention. The choice of the vector will typically depend on the compatibility of the vector with the host cell into which the vector is to be introduced. Preferred vectors are the vectors used in the examples herein. A vector may be a linear polynucleotide or a linear or closed circular plasmid. A vector may be an autonomously replicating vector, i.e., a vector, which exists as an extra-chromosomal entity, the replication of which is independent of chromosomal replication, e.g., a plasmid, an extra-chromosomal element, a mini-chromosome, or an artificial chromosome.

Preferably, in the composition according to the present invention, at least one vector is an autonomously replicating vector, preferably an AMA-vector. An autonomously maintained cloning vector and an AMA-vector preferably comprise the AMA1-sequence (see e.g. Aleksenko and Clutterbuck 1997) or a functional variant or equivalent thereof. A vector may be one which, when introduced into the host cell, becomes integrated into the genome and replicated together with the chromosome(s) into which it has been integrated. An integrative vector may integrate at random or at a predetermined target locus in a chromosome of the host cell. A preferred integrative vector comprises a DNA fragment, which is homologous to a DNA sequence in a predetermined target locus in the genome of the host cell for targeting the integration of the vector to this predetermined locus. In order to promote targeted integration, a vector is preferably linearized prior to transformation of the cell. Linearization is preferably performed such that at least one but preferably either end of the vector is flanked by sequences homologous to the target locus. The length of the homologous sequences flanking the target locus is preferably at least 30 bp, preferably at least 50 bp, preferably at least 0.1 kb, even preferably at least 0.2 kb, more preferably at least 0.5 kb, even more preferably at least 1 kb, most preferably at least 2 kb. Preferably, the efficiency of targeted integration into the genome of the host cell, i.e. integration in a predetermined target locus, is increased by augmented homologous recombination abilities of the host cell.

The homologous flanking DNA sequences in the vector (which are homologous to the target locus) may be derived from a highly expressed locus, meaning that they are derived from a gene, which is capable of high expression level in the host cell. A gene capable of high expression level, i.e. a highly expressed gene, is herein defined as a gene whose mRNA can make up at least 0.5% (w/w) of the total cellular mRNA, e.g. under induced conditions, or alternatively, a gene whose gene product can make up at least 1% (w/w) of the total cellular protein, or, in case of a secreted gene product, can be secreted to a level of at least 0.1 g/l (e.g. as described in EP 357 127 B1).

More than one copy of a polynucleotide according to the present invention may be inserted into the microbial host cell to mediate production of the product encoded by said polynucleotide. This can be done, preferably by integrating multiple copies of the polynucleotide into the genome of the host cell, more preferably by targeting the integration of the polynucleotide at one of the highly expressed loci defined in the former paragraph. Alternatively, integration of multiple copies can be achieved by including an amplifiable selectable marker gene with a polynucleotide according to the present invention, such that cells containing amplified copies of the selectable marker gene (and thereby additional copies of the nucleic acid sequence) can be selected for by cultivating the cells in the presence of the appropriate selectable agent. To increase the number of copies of a polynucleotide according the present invention even more, the technique of gene conversion as described in WO98/46772 may be used.

When a polynucleotide according to the present invention encoding a Cas protein according to the present invention and/or a guide-polynucleotide according to the present invention is integrated into the genome of the host cell, it may be desirable to excise the polynucleotide from the genome, e.g. when the desired genome editing has taken place. The excision of a polynucleotide can be performed by any means known to the person skilled in art; one preferred means is using Amds as a selection marker and counter-selecting with e.g. fluoroacetamide to excise the polynucleotide from the genome such as described in EP0635574. Another means for excision would be to use the well-known Cre/lox system; the polynucleotide sequence encoding the Cas-protein according to the present invention may e.g. be flanked by lox66/71 or loxP/loxP. A further means for excision would be to the use the CRISPR-Cas system according to the present invention. A vector according to the present invention may be a single vector or plasmid or a vector system comprising two or more vectors or plasmids, which together contain the polynucleotides according to the present invention to be introduced into the host cell host cell.

A vector according to the present invention may contain one or more selectable markers, which permit easy selection of transformed cells. In an embodiment, in a composition according to the invention, one or more or all vectors comprise a selectable marker, preferably each vector comprising a distinct selectable marker. A selectable marker is a gene the product of which provides for biocide or viral resistance, resistance to heavy metals, prototrophy to auxotrophs, and the like. The selectable marker may be introduced into the cell on the vector as an expression cassette or may be introduced on a separate vector.

A selectable marker for use in a fungal cell may be selected from the group including, but not limited to, amdS (acetamidase), argB (ornithine carbamoyltransferase), bar (phosphinothricinacetyltransferase), bleA (phleomycin binding), hygB (hygromycinphosphotransferase), niaD (nitrate reductase), pyrG (orotidine-5'-phosphate decarboxylase), sC (sulfate adenyltransferase), NAT or NTC (Nourseothricin) and trpC (anthranilate synthase), KanMX (resistance to G418/geneticin; the selection marker kanMX is a hybrid gene consisting of a bacterial aminoglycoside phosphotransferase (kanr from transposon Tn903) under control of the strong TEF promoter from *Ashbya gossypii*; mammalian cells, yeast, and other eukaryotes acquire resistance to geneticin (=G418, an aminoglycoside antibiotic similar to kanamycin) when transformed with a kanMX marker; in yeast, the kanMX marker avoids the requirement of auxotrophic markers; in addition, the kanMX marker renders *E. coli* resistant to kanamycin.) as well as equivalents from other species.

Markers which can be used in a prokaryotic host cell include ATP synthetase, subunit 9 (oliC), orotidine-5'-phosphatedecarboxylase (pvrA), the ampicillin resistance gene (*E. coli*), resistance genes for neomycin, kanamycin, tetracycline, spectinomycin, erythromycin, chloramphenicol, phleomycin (*Bacillus*) and the *E. coli* uidA gene, coding for β-glucuronidase (GUS). Vectors may be used in vitro, for example for the in vitro production of RNA in an in vitro transcription system or used to transfect or transform a host cell.

Versatile marker genes that can be used for transformation of most yeasts such as acetamidase genes or cDNAs (the amdS, niaD, facA genes or cDNAs from *A. nidulans, A. oryzae* or *A. niger*), or genes providing resistance to antibiotics like G418, hygromycin, bleomycin, kanamycin, methotrexate, phleomycin orbenomyl resistance (benA). Alternatively, specific selection markers can be used such as auxotrophic markers which require corresponding mutant host strains: e.g. D-alanine racemase (from *Bacillus*), URA3 (from *S. cerevisiae* or analogous genes from other yeasts), pyrG or pyrA (from *A. nidulans* or *A. niger*), argB (from *A. nidulans* or *A. niger*) or trpC. In a preferred embodiment the selection marker is deleted from the transformed host cell after introduction of the expression construct so as to obtain transformed host cells capable of producing the polypeptide which are free of selection marker genes.

The procedures used to ligate elements described above to construct a vector according to the present invention are well known to one skilled in the art (see, e.g. Sambrook & Russell, *Molecular Cloning: A Laboratory Manual*, 3rd Ed., CSHL Press, Cold Spring Harbor, N.Y., 2001; and Ausubel et al., *Current Protocols in Molecular Biology*, Wiley Inter-Science, NY, 1995).

A Cas protein in the context of all embodiments of the present invention refers to any Cas protein suitable for the purpose of the invention. A Cas protein may comprise enzymatic activity or may not comprise enzymatic activity. Non-limiting examples of Cas proteins include CasI, CasI B, Cas2, Cas3, Cas4, Cas5, Cas6, Cas7, Cas8, Cas9 (also known as CsnI and CsxI2), CasIO, CsyI, Csy2, Csy3, CseI, Cse2, CscI, Csc2, Csa5, Csn2, Csm2, Csm3, Csm4, Csm5, Csm6, CmrI, Cmr3, Cmr4, Cmr5, Cmr6, CsbI, Csb2, Csb3, CsxI7, CsxI4, CsxIO, CsxI6, CsaX, Csx3, CsxI, CsxIS, Cfl, Csf2, Csf3, Csf4, homologs thereof or modified versions thereof. These Cas proteins are known to the person skilled in the art; for example, the amino acid sequence of *S. pyogenes* Cas9 protein may be found in the SwissProt database under accession number Q99ZW2. Preferably, an unmodified Cas protein according to the present invention has DNA cleavage activity, such as e.g. Cas9. Preferably, a Cas protein according is Cas9, and may be Cas9 from *S. pyogenes* or *S. pneumoniae*. Preferably, a Cas protein according to the present invention directs cleavage of one or both polynucleotide strands at the location of the target-polynucleotide, such as within the target-polynucleotide and/or within the reverse complement of the target-polynucleotide. At the location of the target-polynucleotide is herein defined as within about 1, 2, 3, 4, 5, 6, 7, 8, 9, 10, 15, 20, 25, 50, 100, 200, 500, or more nucleotides from the first or last nucleotide of a target-polynucleotide; more preferably, within 1, 2, 3, 4, 5, 6, 7, 8, 9, 10, 15, 20, 25, 50, 100, 200, 500, or more nucleotides from the first or last nucleotide of a target-polynucleotide; even more preferably, within 1, 2, 3, 4, 5, 6, 7, 8, 9, 10, 15, 20, 25, 50 nucleotides from the first or last nucleotide of a target-polynucleotide. Accordingly, a Cas protein according to the present invention preferably directs cleavage of one or both polynucleotide strands within about 1, 2, 3, 4, 5, 6, 7, 8, 9, 10, 15, 20, 25, 50, 100, 200, 500, or more nucleotides from the first or last nucleotide of a target-polynucleotide; more preferably, within 1, 2, 3, 4, 5, 6, 7, 8, 9, 10, 15, 20, 25, 50, 100, 200, 500, or more nucleotides from the first or last nucleotide of a target-polynucleotide; even more preferably, within 1, 2, 3, 4, 5, 6, 7, 8, 9, 10, 15, 20, 25, 50 nucleotides from the first or last nucleotide of a target-polynucleotide. Typically, a target-polynucleotide according to the present invention is associated with a PAM sequence (defined elsewhere herein) and the PAM sequence is preferably immediately downstream (3') of the target-sequence; the formation of the CRISPR-Cas complex typically results in cleavage of one or both polynucleotide strands 3 base pairs upstream (5') of the PAM sequence. Preferably, a Cas protein in a composition according to the present invention has activity for directing cleavage of both polynucleotide strands at the location of the target-polynucleotide. Cas nuclease activity is typically performed by two separate catalytic domains, namely RuvC and HNH. Each domain cuts one polynucleotide strand each domain can be inactivated by a single point mutation. A Cas protein according to the present invention may thus conveniently be mutated with respect to a corresponding wild-type Cas protein such that the mutated Cas protein has altered nuclease activity and lacks the ability to cleave one or both strands of a target-polynucleotide. For example, an aspartate-to-alanine substitution (D10A) in the RuvC I catalytic domain of Cas9 from *S. pyogenes* converts Cas9 from a nuclease that cleaves both strands to a nickase, which is herein defined as a Cas protein that cleaves a single strand of a target-polynucleotide. Other examples of mutations that render Cas9 into a nickase include, but are not limited to H840A, N854A, and N863A. In the context of the present invention, a Cas protein having nickase activity may be used for genome editing via homologous recombination, preferably the double nicking technique according to Ran et al., 2013. Accordingly, a preferred Cas protein according to the present invention comprises at least one mutation, such that the protein has altered nuclease activity compared to the corresponding wild-type Cas protein, preferably having activity to direct cleavage of a single polynucleotide strand at the location of the target-sequence. Such so-called nickase mutant can conveniently be used in duplex set-up, i.e. in a composition according to the present invention comprising a Cas protein nickase mutant with RuvC mutated and a Cas protein nickase mutant wherein NHN is mutated, such that the one Cas protein mutant nicks one strand of the polynucleotide target and the other Cas protein mutant nicks the other strand of the polynucleotide target. Depending on the two guide-polynucleotides used, the two different CRISPR-Cas complexes will effectively result in two single-strand nicks in the polynucleotide target; these nicks may be several nucleotides up to 5, 10, 20, 30 or more apart. Such double nicking method greatly enhances specificity of NEJH. Background information on double nicking can be found in e.g. Ran et al, 2013.

A Cas protein according to the present invention may comprise two or more mutated catalytic domains of Cas9, such as RuvC I, RuvC II and/or RuvC III to result in a mutated Cas9 substantially lacking all DNA cleavage activity. In some embodiments, a D10A mutation is combined with one or more of H840A, N854A, or N863A mutations to produce a Cas9 enzyme substantially lacking all DNA cleavage activity. Preferably, a Cas protein is considered to substantially lack all DNA cleavage activity when the DNA cleavage activity of the mutated enzyme is less than about 25%, 10%, 5%, 1%, 0.1%, 0.01%, or lower with respect to its non-mutated form. A Cas protein lacking substantially all enzyme activity can conveniently be used for gene silencing or down regulation of expression since the CRISPR-CAS complex will hamper transcription from the target-polynucleotide. Other mutations may be useful; where the Cas9 or other Cas protein is from a species other than *S. pyogenes*, mutations in corresponding amino acids may be made to achieve similar effects; the person skilled in the art knows how to identify these corresponding amino acids.

A Cas protein according to the present invention may be a fusion protein and comprise at least one heterologous functional domain, such domain preferably is a domain comprising FokI activity such as described by Aggarwal et al (Aggarwal, A. K.; Wah, D. A.; Hirsch, J. A.; Dorner, L. F.; Schildkraut, I. (1997). "Structure of the multimodular endonuclease FokI bound to DNA". Nature 388 (6637): 97-100). The enzyme FokI is naturally found in *Flavobacterium okeanokoites* and is a bacterial type IIS restriction endonuclease consisting of an N-terminal DNA-binding domain and a non-specific DNA cleavage domain at the C-terminal (Durai et al., 2005). When the FokI protein is bound to double stranded DNA via its DNA-binding domain at the 5'-GGATG-3':3'-CATCC-5' recognition site, the DNA cleavage domain is activated and cleaves, without further sequence specificity, the first strand 9 nucleotides downstream and the second strand 13 nucleotides upstream of the nearest nucleotide of the recognition site (Wah et al., 1998. Cas9-FokI fusions have been described inter alia in Guilinger et al., 2014; and in Tsai et al., 2014.

A Cas fusion protein according to the present invention may comprise 1, 2, 3, 4, 5, 6, 7, 8, 9, 10, or more domains in addition to the Cas protein. Examples of protein domains that may be fused to a Cas protein include, but are not limited to, epitope tags, reporter gene sequences, and protein domains having one or more of the following activities: methylase activity, demethylase activity, transcription activation activity, transcription repression activity, transcription release factor activity, historic modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A Cas protein may be fused to a gene sequence encoding a protein or a fragment of a protein that bind DNA molecules or bind other cellular molecules, including but not limited to, maltose binding protein (MBP), S-tag, Lex A DNA binding domain (DBD) fusions, GAL4 DNA binding domain fusions, and herpes simplex virus (HSV) BP 16 protein fusions. Additional domains that may form part of a fusion protein comprising a CRISPR enzyme are described in US20110059502. A tagged Cas protein may be used to identify the location of a target-polynucleotide. A preferred Cas fusion protein according to the present invention comprises a FokI domain as defined here above.

A preferred Cas protein according to the present invention comprises a nuclear localization sequence, preferably a heterologous nuclear localization sequence. Such nuclear localization sequence is also referred as a nuclear localization signal. Preferably, such nuclear localization signal confers to the CRISPR-Cas complex sufficient strength to drive accumulation of said CRISPR-Cas complex in a detectable amount in the nucleus of a host cell. Without wishing to be bound by theory, it is believed that a nuclear localization sequence is not necessary for CRISPR-Cas activity in a host cell, but that including such sequences enhances activity of the system, especially as to targeting nucleic acid molecules into the nucleus. Such nuclear localization sequence is preferably present in the Cas protein, but may also be present anywhere else such that targeting of the CRISPR-Cas system to the nucleus is facilitated. A preferred nuclear localization sequence is the SV40 nuclear localization sequence.

In a composition and in any other embodiment according to the present invention a Cas protein encoding polynucleotide is preferably codon optimized for the host cell it is to be expressed in, more preferably the Cas protein encoding polynucleotide is codon pair optimized. In general, codon optimization refers to a process of modifying a nucleic acid sequence for enhanced expression in a host cell of interest by replacing at least one codon (e.g. more than 1, 2, 3, 4, 5, 10, 15, 20, 25, 50, or more codons) of a native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database", and these tables can be adapted in a number of ways. See e.g. Nakamura, Y., et al., 2000. Computer algorithms for codon optimizing a particular sequence for expression in a particular host cell are also available, such as Gene Forge (Aptagen; Jacobus, Pa.), are also available. Preferably, one or more codons (e.g. 1, 2, 3, 4, 5, 10, 15, 20, 25, 50, or more, or all codons) in a sequence encoding a Cas protein correspond to the most frequently used codon for a particular amino acid. Preferred methods for codon optimization are described in WO2006/077258 and WO2008/000632). WO2008/000632 addresses codon-pair optimization. Codon-pair optimization is a method wherein the nucleotide sequences encoding a polypeptide have been modified with respect to their codon-usage, in particular the codon-pairs that are used, to obtain improved expression of the nucleotide sequence encoding the polypeptide and/or improved production of the encoded polypeptide. Codon pairs are defined as a set of two subsequent triplets (codons) in a coding sequence. The amount of Cas protein in a source in a composition according to the present invention may vary and may be optimized for optimal performance. It may be convenient to avoid too high levels of Cas protein in a host cell since high levels of Cas protein may be toxic to the host cell, even without a guide-polynucleotide present (see e.g. Ryan et al 2014 and Jacobs et al., 2014). A person skilled in the art knows how to regulate expression levels, such as by choosing a weaker promoter, repressible promoter or inducible promoter for expression of a Cas protein. Examples of promoters suitable for expression of a protein are depicted elsewhere herein.

In a composition according to the present invention wherein a guide-polynucleotide according to the present invention is encoded by a polynucleotide, expression of the guide-polynucleotide may be facilitated by a promoter operably linked to the encoding polynucleotide. Such promoter may be any suitable promoter known to the person skilled in the art. Several types of promoters can be used. It may be convenient to use an RNA polymerase III promoter or an RNA polymerase II promoter. Background information on RNA polymerase III and its promoters can be found e.g. in Marck et al., 2006. In some cases, such as in *S. cerevisiae*, *S. pombe*, RNA polymerase III promoters include promoter elements in the transcribed region. Accordingly, it may be convenient to use an RNA polymerase II promoter; these are known to the person skilled in the art and reviewed in e.g. Kornberg 1999. However, transcripts from an RNA II polymerase often have complex transcription terminators and transcripts are polyadenylated; this may hamper with the requirements of the guide-polynucleotide which because both its 5' and 3' ends need to be precisely defined in order to achieve the required secondary structure to produce a functional CRISPR-Cas system. These drawbacks can however be circumvented. In case an RNA polymerase II promoter is used, the polynucleotide encoding the guide-polynucleotide may also encode self-processing ribozymes and may be operably linked to an RNA polymerase II promoter; as such the polynucleotide encodes a pre-guide-polynucleotide comprising the guide-polynucleotide and self-processing ribozymes, wherein, when transcribed, the guide-polynucleotide is released by the self-processing ribozymes from the pre-guide-polynucleotide transcript. Preferred constructs comprising a polynucleotide encoding a pre-guide-polynucleotide according to the present invention operably linked to an RNA polymerase II promoter are those depicted in examples 1-10 herein. Background information on such constructs can be found in e.g. Gao et al, 2014 et al.

Preferably, in a composition according to the present invention wherein the guide-polynucleotide is encoded by a polynucleotide, said polynucleotide is operably linked to an H1 RNA polymerase III promoter, preferably a human H1 RNA polymerase III promoter.

Preferably, in a composition according to the present invention wherein the guide-polynucleotide is encoded by a polynucleotide, said polynucleotide is operably linked to a U6 RNA polymerase III promoter, preferably a human U6 RNA polymerase III promoter.

Preferably, in a composition according to the present invention wherein the guide-polynucleotide is encoded by a polynucleotide, said polynucleotide is operably linked to an SNR52p RNA polymerase III promoter, preferably a yeast SNR52p RNA polymerase III promoter. Such promoter is preferably used when the host is a yeast host cell, such as a *Saccharomyces* or a *Kluyveromyces*.

Preferably, in a composition according to the present invention wherein the guide-polynucleotide is encoded by a polynucleotide, said polynucleotide is operably linked to an RNA polymerase II promoter and encodes a pre-guide-polynucleotide comprising the guide-polynucleotide and self-processing ribozymes, wherein, when transcribed, the guide-polynucleotide is released by the self-processing ribozymes from the pre-guide-polynucleotide transcript. Preferred constructs comprising a polynucleotide encoding a pre-guide-polynucleotide according to the present invention operably linked to an RNA polymerase II promoter are those depicted in examples 1-10 herein. Conveniently, multiple pre-guide-polynucleotides and multiple self-processing ribozymes may be encoded by a single polynucleotide, operably linked to one or more RNA polymerase II promoters.

The composition according to the first aspect of the present invention can conveniently be used to modulate expression of a polynucleotide in a host cell. Accordingly, in a second aspect, the present invention provides a method of modulating expression of a polynucleotide in a host cell, comprising contacting a host cell with the composition according to the first aspect of the invention, wherein the guide-polynucleotide directs binding of the Cas protein at the target-polynucleotide in the host cell to form a CRISPR-Cas complex.

The term "expression" in the context of the present invention is herein defined as the process by which a polynucleotide is transcribed from a polynucleotide template (e.g. a DNA template polynucleotide is transcribed into an mRNA polynucleotide transcript or other RNA transcript) and/or the process by which an mRNA transcript is subsequently translated into peptides, polypeptides, or proteins. Transcripts and encoded polypeptides may be collectively referred to as "gene product". If the polynucleotide transcript is derived from a genomic template DNA, expression may include splicing of the mRNA transcript in a host cell. The term "modulating expression" refers herein to increased or reduced expression compared to a parent host cell wherein expressing is not modulated when assayed using the same conditions. Reduced expression may be a reduced amount of transcript such as mRNA and/or a reduced amount of translation product such as a polypeptide. It follows that increased expression may be an enhanced amount of transcript such as mRNA and/or an enhanced amount of translation product such as a polypeptide.

Preferably, the CRISPR-Cas complex cleaves one or both polynucleotide strands at the location of the target-polynucleotide, resulting in modulated expression of the gene product. The CRISPR-Cas complex may also have altered nuclease activity and substantially lack the ability to cleave one or both strands of a target-polynucleotide; in such case, expression is modulated by the binding of the complex to the target-polynucleotide. A Cas protein lacking substantially all enzyme activity can conveniently be used for gene silencing or down regulation of expression since the CRISPR-Cas complex will hamper transcription from the target-polynucleotide. Alternatively, a Cas protein can be modified into a transcription factor for programmable transcriptional activation or silencing of a gene of interest (Larson, et al., 2013).

A composition according to the first aspect of the present invention can conveniently be used for the deletion of polynucleotide. In an embodiment, when the composition according to the first aspect of the present invention comprises a source of at least one or two guide-polynucleotides and/or a source of at least at least one Cas protein, at least one CRISPR-Cas complex or two different CRISPR-Cas complexes are formed that cleave one or both polynucleotide strands at one location or at different locations of the target-polynucleotide, resulting in deletion of a polynucleotide fragment from the target-polynucleotide. Preferably, such composition according to the present invention comprising at least one or two guide-polynucleotides and/or a source of at least at least one Cas protein, additionally comprises an exogenous polynucleotide as defined herein below that is at least partly complementary to the at least one or two target-polynucleotides targeted by the guide-polynucleotide(s). Such polynucleotide fragment to be deleted or deleted fragment may be several nucleotides in length up to a few thousand nucleotides in length, an entire gene may be deleted or a cluster of genes may be deleted. Accordingly, the present invention provides for a method of modulating expression of a polynucleotide in a host cell, wherein a polynucleotide fragment is deleted from a target-polynucleotide.

In an embodiment, the method of modulating expression comprises cleavage of one or both polynucleotide strands at least one location of the target-polynucleotide followed by modification of the target-polynucleotide by homologous recombination with an exogenous polynucleotide. In such case, the composition according to the first aspect of the present invention preferably further comprises such exogenous polynucleotide. Such modification may result in insertion, deletion or substitution of at least one nucleotide in the target-polynucleotide, wherein the insertion or substitution nucleotide may originate from the exogenous polynucleotide. A modification can also be made when the exogenous polynucleotide is a non-integrating entity such as described in Dong et al., and Beetham et al.; in this case the target-polynucleotide is modified but no nucleotide of the exogenous polynucleotide is introduced into the target-polynucleotide. Consequently, the resulting host is a non-recombinant host cell when the Cas-protein according to the invention is transformed as a protein. The exogenous polynucleotide may be any polynucleotide of interest such as a polynucleotide encoding a compound of interest as defined herein below, or a part of such polynucleotide or a variant thereof. Such exogenous polynucleotide is herein referred to as an exogenous polynucleotide according to the present invention and may single-stranded or double-stranded.

Various applications can be considered by the person skilled in the art for the compositions and methods according to the present invention. A polynucleotide (or gene) in a genome may be modified, edited or disrupted using compositions and methods according to the present invention. E.g. when a fully active Cas protein is used that cuts in both strands of the target-polynucleotide and when no exogenous polynucleotide is present as a suitable repair template, the double strand break is repaired by non-homologous end joining repair (NHEJ). During NHEJ insertions and/or deletions (which may be construed as substitution in some cases) of one or several nucleotides may occur, these are randomly inserted or deleted at the repair site; this is characteristic for NHEJ. Such insertions and/or deletions may impact the reading frame of the coding sequence, resulting amino acid changes in the gene product or even a truncated protein in case of genesis of a (premature) stop codon or alteration of a splice site.

A polynucleotide (or gene) in a genome may be modified, edited or disrupted using compositions and methods according to the present invention using homologous end joining repair (HEJ), also known as homology-directed repair (HDR), when an exogenous polynucleotide is present as repair template. E.g. when an exogenous polynucleotide having sequence identity to the target-polynucleotide (i.e. upstream (5') and downstream (3') of the double strand break) is present together with a CRISPR-Cas system according to the present invention, HDR will introduce (or actually reproduce) the corresponding nucleotides of the exogenous polynucleotide at the double strand break in the target-polynucleotide. Preferably, an exogenous polynucleotide according to the present invention does not contain the target sequence itself followed by a functional PAM sequence to avoid the risk of the exogenous polynucleotide itself or the modified target-polynucleotide being (re)cut by the CRISPR-CAS system.

In the embodiments of the present invention, when a CRISPR-Cas system according to the present invention comprises an exogenous polynucleotide (donor polynucleotide, donor DNA, repair template), the CRISPR-Cas system according to the present invention preferably comprises two or more guide-polynucleotides encoded by or present on one or more separate polynucleotides or vectors, and two or more exogenous polynucleotides are provided together with said CRISPR-Cas system enabling the formation of two or more CRISPR-CAS complexes. In a method according to the present invention, such CRISPR-Cas systems according to the present invention can conveniently be used to modulate expression at two or more target-polynucleotides, i.e. a method to target multiple target sites. Such CRISPR-Cas system according to the present invention will by chance form one, two or more CRISPR-CAS complexes at one or more target-polynucleotides. Such method can be used to generate one or more insertions, deletions, substitutions, optionally in combination with the one or more exogenous polynucleotides, in the genome of the host cell, or to modulate expression of genes via the formed CRISPR-CAS complexes.

In the embodiments of the present invention when a CRISPR-Cas system according to the present invention comprises an exogenous polynucleotide (donor polynucleotide, repair template), the exogenous polynucleotide and the guide-polynucleotide may be encoded by or present on a single polynucleotide. This enables synthesis of two or more of such combination polynucleotides and even library synthesis of such combination polynucleotides. Such library can be provided as a pool and be used to make a library of vectors and/or polynucleotides where the guide-polynucleotide and the exogenous polynucleotide are together encoded by or present on one polynucleotide. Such pool enables the use of a CRISPR-Cas system according to the present invention in a library-like multiplex system. In such CRISPR-Cas system according to the present invention, the exogenous polynucleotide and the guide-polynucleotide may be directly connected or may be separated by a linker polynucleotide.

In an embodiment, the guide-polynucleotide and the exogenous polynucleotide are connected by a linker polynucleotide that encodes for or represents the right flank of the guide-polynucleotide encoding or representing the gRNA 3' sequence and terminator, or a linker polynucleotide that encodes for or represents the left flank of the guide-polynucleotide encoding or representing the gRNA 5' sequence and promoter. This enables synthesis of two or more of such combination polynucleotides and even library synthesis of such combination polynucleotides. Such combination polynucleotides can be further processed to form a combination polynucleotide with one or more functional guide-polynucleotide(s) (containing a promoter and terminator).

In an embodiment, the guide-polynucleotide and the exogenous polynucleotide are connected by a linker polynucleotide that encodes for or represents the right flank of the guide-polynucleotide encoding or representing the gRNA 3' sequence and terminator and the polynucleotide target for said guide-polynucleotide, or a linker polynucleotide that encodes for or represents the polynucleotide target for said guide-polynucleotide and the left flank of the guide-polynucleotide encoding or representing the gRNA 5' sequence and promoter, where in vivo a CRISPR-Cas system can be formed at the combination polynucleotide to cleave the combination polynucleotide.

In an embodiment, one or more combination polynucleotides according to the present invention can be recombined (e.g. via direct cloning or in vivo recombination) with one or more vectors encoding Cas protein according to the present invention. One or more of such recombined vectors enable the formation of one or more CRISPR-CAS complexes. The host cell according to this aspect of the present invention may be any host cell as defined herein. A preferred host cell is a modified host cell wherein expression of a component associated with non-homologous end joining (NHEJ) is altered compared to the corresponding wild-type host cell; preferably expression of the component associated with NHEJ is lowered. Preferred components associated with NHEJ are the yeast Ku70 and Ku80 and their respective orthologs in preferred non-mammalian host cells according to the present invention. Another preferred component associated with NHEJ is the yeast LIG4 and its respective orthologs in preferred non-mammalian host cells according to the present invention.

In a method according to this aspect of the present invention, a preferred host cell comprises a polynucleotide encoding a compound of interest as defined elsewhere herein.

In a method according to this aspect of the present invention, the host cell may be a recombinant host cell or may be a non-recombinant host cell.

A method of modulating expression of a polynucleotide in a host cell according to this aspect of the present invention, results in a modified host cell that preferably comprises components of the composition according to the first aspect of the present invention. Accordingly, in a third aspect the present invention provides for a host cell comprising a composition according to the first aspect of the present invention. Such host cell may be any host cell as defined herein and may further comprise a polynucleotide encoding a compound of interest as defined elsewhere herein.

In a fourth aspect, the present invention provides a method of producing a host cell, comprising contacting a host cell with the composition according to the first aspect of the present invention, wherein the guide-polynucleotide directs binding of the Cas protein at the target-polynucleotide in the host cell to form a CRISPR-Cas complex. In an embodiment, the contacting with the composition according to the first aspect of the invention may be performed in two steps, wherein the host cell is first contacted with a source of a Cas protein according to the invention and subsequently the host cell is contacted with a source of a guide-polynucleotide according to the invention and optionally an exogenous polynucleotide according to the invention. A host cell in this embodiment of the present invention may be any type of host cell as defined herein and may comprise a polynucleotide encoding a compound of interest as defined elsewhere herein. A preferred method of producing a host cell according to the present invention comprises a step to produce an offspring host cell, wherein in said offspring host cell no components of a CRISPR-Cas system according to the present invention are present anymore. A further preferred host cell is a modified host cell wherein expression of a component associated with NHEJ as depicted here above is altered compared to the corresponding wild-type host cell; preferably expression of the component associated with NHEJ is lowered.

The composition according to the first aspect of the present invention may be any such composition as defined herein. Contacting a host cell with a composition according to the present invention may be performed by any means known to the person skilled in the art. A host cell according to the present invention may simply be brought into a solution comprising a composition according to the present invention. Specific means of delivering a composition according to the present invention into a host cell may be used. The person skilled in the art is aware of such methods (see e.g. Sambrook & Russell; Ausubel, supra)., which include but are not limited to electroporation methods, particle bombardment or microprojectile bombardment, protoplast methods and *Agrobacterium* mediated transformation (AMT). Yeast may be transformed using any method known in the art such as the procedures described by Becker and Guarente, In Abelson, J. N. and Simon, 1983; Hinnen et al., 1978, and Gietz R D, Woods R A. 2002.

Preferably, the CRISPR-Cas complex cleaves one or both polynucleotide strands at the location of the target-polynucleotide, resulting in modulated expression of the gene product. The CRISPR-Cas complex may also have altered nuclease activity and lack the ability to cleave one or both strands of a target-polynucleotide; in such case, expression is modulated by the binding of the complex to the target-polynucleotide.

In an embodiment, when the composition according to the first aspect of the present invention comprises a source of at least one or two guide-polynucleotides and/or a source of at least one Cas protein, at least one CRISPR-Cas complex or two different CRISPR-CAS complexes are formed that cleave one or both polynucleotide strands at one location or at different locations of the target-polynucleotide, resulting in deletion of a polynucleotide fragment from the target-polynucleotide. Preferably, such composition according to the present invention comprising at least one or two guide-polynucleotides and/or a source of at least at least one Cas protein, additionally comprises an exogenous polynucleotide as defined herein below that is at least partly complementary to the at least one or two target-polynucleotides targeted by the guide-polynucleotide(s). Such polynucleotide fragment to be deleted or deleted fragment may be from several nucleotides in length up to a few thousand nucleotides in length, an entire gene may be deleted or a cluster of genes may be deleted. Accordingly, the present invention provides for a method of modulating expression of a polynucleotide in a host cell, wherein a polynucleotide fragment is deleted from a target-polynucleotide.

In one embodiment a method of modulating expression of a polynucleotide in a host cell, wherein a polynucleotide fragments is deleted from a target-polynucleotide, comprises contacting a host cell with a composition as described herein, wherein the guide-polynucleotide directs binding of the Cas protein at the target-polynucleotide in the host cell to form a CRISPR-Cas complex. Preferably a method of modulating expression of a polynucleotide in a host cell, wherein a polynucleotide fragments is deleted from a target-polynucleotide, comprises contacting a host cell with a composition as described herein, wherein the guide-polynucleotide directs binding of the Cas protein at the target-polynucleotide in the host cell to form a CRISPR-Cas complex, wherein the host cell is a modified host cell deficient in a component associated with NHEJ. In another preferred embodiment a method of modulating expression of a polynucleotide in a host cell, wherein a polynucleotide fragments is deleted from a target-polynucleotide, comprises contacting a host cell with a composition as descried herein, wherein the guide-polynucleotide directs binding of the Cas protein at the target-polynucleotide in the host cell to form a CRISPR-Cas complex, wherein the host cell is a modified host cell deficient in a component associated with NHEJ, wherein the composition as described herein does not comprise an exogenous or donor polynucleotide. In one preferred embodiment the component associated with NHEJ is a yeast Ku70 or a yeast Ku80 or a yeast LIG4 or its respective ortholog in the host cells according to the present invention. In another embodiment of the method of modulating expression of a polynucleotide in a host cell the composition is comprised in an autonomously replicating vector.

Therefore the present invention relates in one embodiment to a method of modulating expression of a polynucleotide in a cell, wherein a polynucleotide fragment is deleted from a target-polynucleotide, comprising contacting a host cell with the composition as described herein but preferably not comprising a donor polynucleotide as defined herein, wherein the guide-polynucleotide directs binding of the Cas protein at the target-polynucleotide in the host cell to form a CRISPR-Cas complex, wherein the host cell is deficient in a component associated with NHEJ, preferably a yeast Ku70 or yeast Ku80 or a yeast LIG4 or its respective ortholog in the host cells.

Surprisingly it has been found that in a host cell deficient in a gene involved in NHEJ it is possible to obtain deletions in the host cell genome in a controlled way by using the CRISPR/CAS9 system when regions of homology are present at both sites of the intended cleavage site and wherein the composition as described herein does not comprise a donor DNA, in a method of modulating expression of a polynucleotide in a cell, wherein a polynucleotide fragment is deleted from a target-polynucleotide, as described herein.

Therefore in one embodiment the invention relates to a method of modulating expression of a polynucleotide in a cell, wherein a polynucleotide fragment is deleted from a target-polynucleotide, comprising contacting a host cell with a non-naturally occurring or engineered composition comprising a source of a CRISPR-Cas system comprising a guide-polynucleotide and a Cas protein, wherein the guide-polynucleotide comprises a guide-sequence that essentially is the reverse complement of a target-polynucleotide in a host cell and the guide-polynucleotide can direct binding of the Cas protein at the target-polynucleotide in the host cell to form a CRISPR-Cas complex, wherein the guide-sequence is essentially the reverse complement of the (N)y part of a 5'-(N)yPAM-3' polynucleotide sequence target in the genome of the host cell, wherein y is an integer of 8-30, wherein PAM is a protospacer adjacent motif, wherein the host cell is a lipolytic yeast, preferably a *Yarrowia*, more preferably a *Yarrowia lipolytica*, even more preferably *Yarrowia lipolytica* CL1B122 or *Yarrowia lipolytica* ML324 (deposited under number ATCC18943) and wherein PAM is preferably a sequence selected from the group consisting of 5'-XGG-3', 5'-XGGXG-3', 5'-XXAGAAW-3', 5'-XXXX-GATT-3', 5'-XXAGAA-3', 5'-XAAAAC-3', wherein X can be any nucleotide or analog thereof, preferably X can be any nucleotide; and W is A or T herein but preferably not comprising a donor polynucleotide as defined herein, wherein the guide-polynucleotide directs binding of the Cas protein at the target-polynucleotide in the host cell to form a CRISPR-Cas complex, wherein the host cell is deficient in a component associated with NHEJ, preferably a yeast Ku70 or yeast Ku80 or a yeast LIG4 or its respective ortholog in the host cells, wherein the Cas protein has activity for directing cleavage of both polynucleotide strands at the location of the target-sequence and wherein the cleavage occurs in a region of the genome comprised between two homologous regions which upon cleavage by the Cas protein recombine with each other resulting in the deletion of a polynucleotide comprised between said regions.

Preferably the degree of homology between the two homologous regions is such to allow homologous recombination. Preferably the two homologous regions have at least 60%, 70%, 80%, 90%, 99% or 100% sequence identity over the whole length of the homologous regions. It has been surprisingly found that the length of homologous region can be very short even in filamentous fungi, wherein usually a length of at least 1 or several kb is necessary to allow homologous recombination. Therefore in a preferred embodiment the length of the homologous regions is preferably at most 1 kb, at most 0.5 kb, at most 100 bp, at most 50 bp, at most 40 bp, at most 30 bp, at most 20 bp, at most 10 bp.

Preferably the distance between the two homologous regions is at most 10 kb, at most 9, at most 8 kb, at most 7 kb, at most 6 kb, at most 5 kb, at most 4 kb, at most 3 kb, at most 2 kb, at most 1 kb, at most 0.5 kb, at most 100 bp, at most 50 bp, at most 40 bp, at most 30, 20, 10 kb.

In one aspect, the invention relates to a software algorithms able to identify PAM sites in the genome comprised between homology regions of about 7-20 bp in a neighbourhood of the PAM site to design a method to target one or more PAM sites and create deletion of polynucleotides without use of a donor DNA.

The above method can be used for efficient removal of polynucleotide sequences in a designed way. For example upon introducing a Cas9 expression cassette at the genomic DNA and after several rounds of modifications mediated by the CRISPR/CAS9 system, one can remove the CAS9 from the genome by the introduction of a gRNA targeting a site in the Cas9 expression cassette and wherein the Cas9 expression cassette is comprised between two homologous regions as defined above, preferably 100-bp long, more preferably 20-bp, 15-bp long or shorter and cleave out the Cas9 open reading frame or a large part of the expression cassette.

The above method can also be used for transient inactivation of a gene. E.g. one could for example make a gene, e.g. a Ku70 polynucleotide non-functional by inserting a polynucleotide sequence in the ORF of the Ku70 gene, comprising two homologous regions at its 5'-end and 3'end respectively, wherein preferably the homologous regions are 100-bp, more preferably 20-bp, 15-bp long or shorter. The Ku70 gene can be made functional again using a CRISPR-Cas9 system without donor DNA as described above.

In an embodiment, the method of modulating expression comprises cleavage of one or both polynucleotide strands at least one location of the target-polynucleotide followed by modification of the target-polynucleotide by homologous recombination with an exogenous polynucleotide. In such case, the composition according to the first aspect of the present invention preferably further comprises such exogenous polynucleotide. Such modification may result in insertion, deletion or substitution of at least one nucleotide in the target-polynucleotide, wherein the insertion or substitution nucleotide may or may not originate from the exogenous polynucleotide. In one embodiment the exogenous polynucleotide comprises regions of homology with the target-polynucleotide. Preferably the degree of homology between these homologous regions is such to allow homologous recombination. Preferably the homologous regions have at least 60%, 70%, 80%, 90%, 99% or 100% sequence identity over the whole length of the homologous regions. In one embodiment, wherein the host cell is deficient in a component involve in NHEJ as defined herewith, the homologous regions are preferably at most 1 kb, at most 0.5 kb, at most 100 bp, at most 50 bp, at most 40 bp, at most 30 bp, at most 20 bp, at most 10 bp. A modification can also be made when the exogenous polynucleotide is a non-integrating entity; in this case the target-polynucleotide is modified but no nucleotide of the exogenous polynucleotide is introduced into the target-polynucleotide. Consequently, the resulting host is a non-recombinant host when the Cas-protein according to the present invention is transformed as a protein. In a method according to this aspect of the present invention, the host cell may thus be a recombinant host cell or may be a non-recombinant host cell. The exogenous polynucleotide may be any polynucleotide of interest such as a polynucleotide encoding a compound of interest as defined herein, or a part of such polynucleotide or a variant thereof.

In a fifth aspect, the present invention provides for a method for the production of a compound of interest, comprising culturing under conditions conducive to the compound of interest a host cell according to the third or fourth aspect of the present invention or a host cell obtained by a method according to the second aspect of the present invention, or a host cell obtainable by a method according to the fourth aspect of the present invention and optionally purifying or isolating the compound of interest.

A compound of interest in the context of all embodiments of the present invention may be any biological compound. The biological compound may be biomass or a biopolymer or a metabolite. The biological compound may be encoded by a single polynucleotide or a series of polynucleotides composing a biosynthetic or metabolic pathway or may be the direct result of the product of a single polynucleotide or products of a series of polynucleotides, the polynucleotide may be a gene, the series of polynucleotide may be a gene cluster. In all embodiments of the present invention, the single polynucleotide or series of polynucleotides encoding the biological compound of interest or the biosynthetic or metabolic pathway associated with the biological compound of interest, are preferred targets for the compositions and methods according to the present invention. The biological compound may be native to the host cell or heterologous to the host cell.

The term "heterologous biological compound" is defined herein as a biological compound which is not native to the cell; or a native biological compound in which structural modifications have been made to alter the native biological compound.

The term "biopolymer" is defined herein as a chain (or polymer) of identical, similar, or dissimilar subunits (monomers). The biopolymer may be any biopolymer. The biopolymer may for example be, but is not limited to, a nucleic acid, polyamine, polyol, polypeptide (or polyamide), or polysaccharide.

The biopolymer may be a polypeptide. The polypeptide may be any polypeptide having a biological activity of interest. The term "polypeptide" is not meant herein to refer to a specific length of the encoded product and, therefore, encompasses peptides, oligopeptides, and proteins. The term polypeptide refers to polymers of amino acids of any length. The polymer may he linear or branched, it may comprise modified amino acids, and it may be interrupted by non amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. Polypeptides further include naturally occurring allelic and engineered variations of the above-mentioned polypeptides and hybrid polypeptides. The polypeptide may be native or may be heterologous to the host cell. The polypeptide may be a collagen or gelatine, or a variant or hybrid thereof. The polypeptide may be an antibody or parts thereof, an antigen, a clotting factor, an enzyme, a hormone or a hormone variant, a receptor or parts thereof, a regulatory protein, a structural protein, a reporter, or a transport protein, protein involved in secretion process, protein involved in folding process, chaperone, peptide amino acid transporter, glycosylation factor, transcription factor, synthetic peptide or oligopeptide, intracellular protein. The intracellular protein may be an enzyme such as, a protease, ceramidases, epoxide hydrolase, aminopeptidase, acylases, aldolase, hydroxylase, aminopeptidase, lipase. The polypeptide may also be an enzyme secreted extracellularly. Such enzymes may belong to the groups of oxidoreductase, transferase, hydrolase, lyase, isomerase, ligase, catalase, cellulase, chitinase, cutinase, deoxyribonuclease, dextranase, esterase. The enzyme may be a carbohydrase, e.g. cellulases such as endoglucanases, β-glucanases, cellobiohydrolases or β-glucosidases, hemicellulases or pectinolytic enzymes such as xylanases, xylosidases, mannanases, galactanases, galactosidases, pectin methyl esterases, pectin lyases, pectate lyases, endo polygalacturonases, exopolygalacturonases rhamnogalacturonases, arabanases, arabinofuranosidases, arabinoxylan hydrolases, galacturonases, lyases, or amylolytic enzymes; hydrolase, isomerase, or ligase, phosphatases such as phytases, esterases such as lipases, proteolytic enzymes, oxidoreductases such as oxidases, transferases, or isomerases. The enzyme may be a phytase. The enzyme may be an aminopeptidase, asparaginase, amylase, a maltogenic amylase, carbohydrase, carboxypeptidase, endo-protease, metallo-protease, serine-protease catalase, chitinase, cutinase, cyclodextrin glycosyltransferase, deoxyribonuclease, esterase, alpha-galactosidase, beta-galactosidase, glucoamylase, alpha-glucosidase, beta-glucosidase, haloperoxidase, protein deaminase, invertase, laccase, lipase, mannosidase, mutanase, oxidase, pectinolytic enzyme, peroxidase, phospholipase, galactolipase, chlorophyllase, polyphenoloxidase, ribonuclease, transglutaminase, or glucose oxidase, hexose oxidase, monooxygenase.

According to the present invention, a compound of interest can be a polypeptide or enzyme with improved secretion features as described in WO2010/102982. According to the present invention, a compound of interest can be a fused or hybrid polypeptide to which another polypeptide is fused at the N-terminus or the C-terminus of the polypeptide or fragment thereof. A fused polypeptide is produced by fusing a nucleic acid sequence (or a portion thereof) encoding one polypeptide to a nucleic acid sequence (or a portion thereof) encoding another polypeptide.

Techniques for producing fusion polypeptides are known in the art, and include, ligating the coding sequences encoding the polypeptides so that they are in frame and expression of the fused polypeptide is under control of the same promoter(s) and terminator. The hybrid polypeptides may comprise a combination of partial or complete polypeptide sequences obtained from at least two different polypeptides wherein one or more may be heterologous to the host cell. Example of fusion polypeptides and signal sequence fusions are for example as described in WO2010/121933.

The biopolymer may be a polysaccharide. The polysaccharide may be any polysaccharide, including, but not limited to, a mucopolysaccharide (e.g., heparin and hyaluronic acid) and nitrogen-containing polysaccharide (e.g., chitin). In a preferred option, the polysaccharide is hyaluronic acid.

A polynucleotide coding for the compound of interest or coding for a compound involved in the production of the compound of interest according to the invention may encode an enzyme involved in the synthesis of a primary or secondary metabolite, such as organic acids, carotenoids, (beta-lactam) antibiotics, and vitamins. Such metabolite may be considered as a biological compound according to the present invention.

The term "metabolite" encompasses both primary and secondary metabolites; the metabolite may be any metabolite. Preferred metabolites are citric acid, gluconic acid, adipic acid, fumaric acid, itaconic acid and succinic acid.

A metabolite may be encoded by one or more genes, such as in a biosynthetic or metabolic pathway. Primary metabolites are products of primary or general metabolism of a cell, which are concerned with energy metabolism, growth, and structure. Secondary metabolites are products of secondary metabolism (see, for example, R. B. Herbert, The Biosynthesis of Secondary Metabolites, Chapman and Hall, New York, 1981).

A primary metabolite may be, but is not limited to, an amino acid, fatty acid, nucleoside, nucleotide, sugar, triglyceride, or vitamin.

A secondary metabolite may be, but is not limited to, an alkaloid, coumarin, flavonoid, polyketide, quinine, steroid, peptide, or terpene. The secondary metabolite may be an antibiotic, antifeedant, attractant, bacteriocide, fungicide, hormone, insecticide, or rodenticide. Preferred antibiotics are cephalosporins and beta-lactams. Other preferred metabolites are exo-metabolites. Examples of exo-metabolites are Aurasperone B, Funalenone, Kotanin, Nigragillin, Orlandin, Other naphtho-γ-pyrones, Pyranonigrin A, Tensidol B, Fumonisin B2 and Ochratoxin A.

The biological compound may also be the product of a selectable marker. A selectable marker is a product of a polynucleotide of interest which product provides for biocide or viral resistance, resistance to heavy metals, protrophy to auxotrophs, and the like. Selectable markers include, but are not limited to, amdS (acetamidase), argB (ornithinecarbamoyltransferase), bar (phosphinothricinacetyltransferase), hygB (hygromycin phosphotransferase), niaD (nitrate reductase), pyrG (orotidine-5'-phosphate decarboxylase), sC (sulfate adenyltransferase), trpC (anthranilate synthase), ble (phleomycin resistance protein), hyg (hygromycin), NAT or NTC (Nourseothricin) as well as equivalents thereof.

According to the invention, a compound of interest is preferably a polypeptide as described in the list of compounds of interest.

According to another embodiment of the invention, a compound of interest is preferably a metabolite.

The host cell according to the present invention may already be capable of producing the compound of interest. The mutant microbial host cell may also be provided with a homologous or heterologous nucleic acid construct that encodes a polypeptide wherein the polypeptide may be the compound of interest or a polypeptide involved in the production of the compound of interest. The person skilled in the art knows how to modify a microbial host cell such that it is capable of producing the compound of interest General Definitions Throughout the present specification and the accompanying claims, the words "comprise", "include" and "having" and variations such as "comprises", "comprising", "includes" and "including" are to be interpreted inclusively. That is, these words are intended to convey the possible inclusion of other elements or integers not specifically recited, where the context allows.

The terms "a" and "an" are used herein to refer to one or to more than one (i.e. to one or at least one) of the grammatical object of the article. By way of example, "an element" may mean one element or more than one element.

The word "about" or "approximately" when used in association with a numerical value (e.g. about 10) preferably means that the value may be the given value (of 10) more or less 1% of the value.

A preferred nucleotide analogue or equivalent comprises a modified backbone. Examples of such backbones are provided by morpholino backbones, carbamate backbones, siloxane backbones, sulfide, sulfoxide and sulfone backbones, formacetyl and thioformacetyl backbones, methyleneformacetyl backbones, riboacetyl backbones, alkene containing backbones, sulfamate, sulfonate and sulfonamide backbones, methyleneimino and methylenehydrazino backbones, and amide backbones. It is further preferred that the linkage between a residue in a backbone does not include a phosphorus atom, such as a linkage that is formed by short chain alkyl or cycloalkyl internucleoside linkages, mixed heteroatom and alkyl or cycloalkyl internucleoside linkages, or one or more short chain heteroatomic or heterocyclic internucleoside linkages.

A preferred nucleotide analogue or equivalent comprises a Peptide Nucleic Acid (PNA), having a modified polyamide backbone (Nielsen, et al. (1991) Science 254, 1497-1500). PNA-based molecules are true mimics of DNA molecules in terms of base-pair recognition. The backbone of the PNA is composed of N-(2-aminoethyl)-glycine units linked by peptide bonds, wherein the nucleobases are linked to the backbone by methylene carbonyl bonds. An alternative backbone comprises a one-carbon extended pyrrolidine PNA monomer (Govindaraju and Kumar (2005) Chem. Commun, 495-497). Since the backbone of a PNA molecule contains no charged phosphate groups, PNA-RNA hybrids are usually more stable than RNA-RNA or RNA-DNA hybrids, respectively (Egholm et al (1993) Nature 365, 566-568).

A further preferred backbone comprises a morpholino nucleotide analog or equivalent, in which the ribose or deoxyribose sugar is replaced by a 6-membered morpholino ring. A most preferred nucleotide analog or equivalent comprises a phosphorodiamidate morpholino oligomer (PMO), in which the ribose or deoxyribose sugar is replaced by a 6-membered morpholino ring, and the anionic phosphodiester linkage between adjacent morpholino rings is replaced by a non-ionic phosphorodiamidate linkage.

A further preferred nucleotide analogue or equivalent comprises a substitution of at least one of the non-bridging oxygens in the phosphodiester linkage. This modification slightly destabilizes base-pairing but adds significant resistance to nuclease degradation. A preferred nucleotide analogue or equivalent comprises phosphorothioate, chiral phosphorothioate, phosphorodithioate, phosphotriester, aminoalkylphosphotriester, H-phosphonate, methyl and other alkyl phosphonate including 3'-alkylene phosphonate, 5'-alkylene phosphonate and chiral phosphonate, phosphinate, phosphoramidate including 3'-amino phosphoramidate and aminoalkylphosphoramidate, thionophosphoramidate, thionoalkylphosphonate, thionoalkylphosphotriester, selenophosphate or boranophosphate. A further preferred nucleotide analogue or equivalent comprises one or more sugar moieties that are mono- or disubstituted at the 2', 3' and/or 5' position such as a —OH; —F; substituted or unsubstituted, linear or branched lower (C1-C10) alkyl, alkenyl, alkynyl, alkaryl, allyl, aryl, or aralkyl, that may be interrupted by one or more heteroatoms; O—, S—, or N-alkyl; O—, S—, or N-alkenyl; O—, S—or N-alkynyl; O—, S—, or N-allyl; O-alkyl-O-alkyl, -methoxy, -aminopropoxy; aminoxy, methoxyethoxy; -dimethylaminooxyethoxy; and -dimethylaminoethoxyethoxy. The sugar moiety can be a pyranose or derivative thereof, or a deoxypyranose or derivative thereof, preferably a ribose or a derivative thereof, or deoxyribose or derivative thereof. Such preferred derivatized sugar moieties comprise Locked Nucleic Acid (LNA), in which the 2'-carbon atom is linked to the 3' or 4' carbon atom of the sugar ring thereby forming a bicyclic sugar moiety. A preferred LNA comprises 2'-O,4'-C-ethylene-bridged nucleic acid (Morita et al. 2001. Nucleic Acid Res Supplement No. 1: 241-242). These substitutions render the nucleotide analogue or equivalent RNase H and nuclease resistant and increase the affinity for the target.

"Sequence identity" or "identity" in the context of the present invention of an amino acid- or nucleic acid-sequence is herein defined as a relationship between two or more amino acid (peptide, polypeptide, or protein) sequences or two or more nucleic acid (nucleotide, oligonucleotide, polynucleotide) sequences, as determined by comparing the sequences. In the art, "identity" also means the degree of sequence relatedness between amino acid or nucleotide sequences, as the case may be, as determined by the match between strings of such sequences. Within the present invention, sequence identity with a particular sequence preferably means sequence identity over the entire length of said particular polypeptide or polynucleotide sequence.

"Similarity" between two amino acid sequences is determined by comparing the amino acid sequence and its conserved amino acid substitutes of one peptide or polypeptide to the sequence of a second peptide or polypeptide. In a preferred embodiment, identity or similarity is calculated over the whole sequence (SEQ ID NO:) as identified herein. "Identity" and "similarity" can be readily calculated by known methods, including but not limited to those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heine, G., Academic Press, 1987; and Sequence Analysis Primer, Gribskov, M. and Devereux, J., eds., M Stockton Press, New York, 1991; and Carillo, H., and Lipman, D., SIAM J. Applied Math., 48:1073 (1988). Preferred methods to determine identity are designed to give the largest match between the sequences tested. Methods to determine identity and similarity are codified in publicly available computer programs. Preferred computer program methods to determine identity and similarity between two sequences include e.g. the GCG program package (Devereux, J., et al., Nucleic Acids Research 12 (1): 387 (1984)), BestFit, BLASTP, BLASTN, and FASTA (Altschul, S. F. et al., J. Mol. Biol. 215:403-410 (1990). The BLAST X program is publicly available from NCBI and other sources (BLAST Manual, Altschul, S., et al., NCBI NLM NIH Bethesda, Md. 20894; Altschul, S., et al., J. Mol. Biol. 215:403-410 (1990). The well-known Smith Waterman algorithm may also be used to determine identity.

Preferred parameters for polypeptide sequence comparison include the following: Algorithm: Needleman and Wunsch, J. Mol. Biol. 48:443-453 (1970); Comparison matrix: BLOSSUM62 from Hentikoff and Hentikoff, Proc. Natl. Acad. Sci. USA. 89:10915-10919 (1992); Gap Penalty: 12; and Gap Length Penalty: 4. A program useful with these parameters is publicly available as the "Ogap" program from Genetics Computer Group, located in Madison, Wis. The aforementioned parameters are the default parameters for amino acid comparisons (along with no penalty for end gaps).

Preferred parameters for nucleic acid comparison include the following: Algorithm: Needleman and Wunsch, J. Mol. Biol. 48:443-453 (1970); Comparison matrix: matches=+10, mismatch=0; Gap Penalty: 50; Gap Length Penalty: 3. Available as the Gap program from Genetics Computer Group, located in Madison, Wis. Given above are the default parameters for nucleic acid comparisons.

Optionally, in determining the degree of amino acid similarity, the skilled person may also take into account so-called "conservative" amino acid substitutions, as will be clear to the skilled person. Conservative amino acid substitutions refer to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulphur-containing side chains is cysteine and methionine. Preferred conservative amino acids substitution groups are: valine-leucine-isoleucine, phenylalanine-tyrosine, lysine-arginine, alanine-valine, and asparagine-glutamine. Substitutional variants of the amino acid sequence disclosed herein are those in which at least one residue in the disclosed sequences has been removed and a different residue inserted in its place. Preferably, the amino acid change is conservative. Preferred conservative substitutions for each of the naturally occurring amino acids are as follows: Ala to ser; Arg to lys; Asn to gln or his; Asp to glu; Cys to ser or ala; Gln to asn; Glu to asp; Gly to pro; His to asn or gln; Ile to leu or val; Leu to ile or val; Lys to arg; gln or glu; Met to leu or ile; Phe to met, leu or tyr; Ser to thr; Thr to ser; Trp to tyr; Tyr to trp or phe; and, Val to ile or leu.

A polynucleotide according to the present invention is represented by a nucleotide sequence. A polypeptide according to the present invention is represented by an amino acid sequence. A nucleic acid construct according to the present invention is defined as a polynucleotide which is isolated from a naturally occurring gene or which has been modified to contain segments of polynucleotides which are combined or juxtaposed in a manner which would not otherwise exist in nature. Optionally, a polynucleotide present in a nucleic acid construct according to the present invention is operably linked to one or more control sequences, which direct the production or expression of the encoded product in a host cell or in a cell-free system.

The sequence information as provided herein should not be so narrowly construed as to require inclusion of erroneously identified bases. The skilled person is capable of identifying such erroneously identified bases and knows how to correct for such errors.

All embodiments of the present invention, i.e. a composition according to the present invention, a method of modulating expression, a host cell comprising a composition according to the present invention, a method of producing a host cell according to the present invention, a host cell according to the present invention and a method for the production of a compound of interest according to the present invention preferably refer to host cell, not to a cell-free in vitro system; in other words, the CRISPR-Cas systems according to the present invention are preferably host cell systems, not cell-free in vitro systems.

In all embodiments of the present invention, e.g. a composition according to the present invention, a method of modulating expression, a host cell comprising a composition according to the present invention, a method of producing a host cell according to the present invention, a host cell according to the present invention and a method for the production of a compound of interest according to the present invention, the host cell may be a haploid, diploid or polyploid host cell.

The host cell according to the present invention is a lipolytic yeast host cell, preferably a *Yarrowia*, more preferably a *Yarrowia lipolytica*, even more preferably a *Yarrowia lipolytica* CLIB122 or a *Yarrowia lipolytica* ML324 (deposited as ATCC18943).

Preferably, a host cell according to the present invention further comprises one or more modifications in its genome such that the host cell is deficient in the production of at least one product selected from glucoamylase (glaA), acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, PepA, a product encoded by the gene hdfA and/or hdfB, a non-ribosomal peptide synthase npsE if compared to a parent host cell and measured under the same conditions.

Preferably, the efficiency of targeted integration of a polynucleotide to a pre-determined site into the genome of a host cell according to the invention is increased by rendering the cell deficient in a component in NHEJ (non-homologous recombination). Preferably, a host cell according to the invention comprises a polynucleotide encoding an NHEJ component comprising a modification, wherein said host cell is deficient in the production of said NHEJ component compared to a parent cell it originates from when cultivated under the same conditions.

The NHEJ component to be modified can be any NHEJ component known to the person skilled in the art. Preferred NHEJ components to be modified are selected from the group of homologues of yeast KU70, KU80, MRE11, RAD50, RAD51, RAD52, XRS2, SIR4, LIG4. A modification, preferably in the genome, is construed herein as one or more modifications. A modification, preferably in the genome of a host cell according to the present invention, can either be effected by a) subjecting a parent host cell to recombinant genetic manipulation techniques; and/or
b) subjecting a parent host cell to (classical) mutagenesis; and/or
c) subjecting a parent host cell to an inhibiting compound or composition. Modification of a genome of a host cell is herein defined as any event resulting in a change in a polynucleotide sequence in the genome of the host cell.

Preferably, a host cell according to the present invention has a modification, preferably in its genome which results in a reduced or no production of an undesired compound as defined herein if compared to the parent host cell that has not been modified, when analysed under the same conditions.

A modification can be introduced by any means known to the person skilled in the art, such as but not limited to classical strain improvement, random mutagenesis followed by selection. Modification can also be introduced by site-directed mutagenesis.

Modification may be accomplished by the introduction (insertion), substitution (replacement) or removal (deletion) of one or more nucleotides in a polynucleotide sequence. A full or partial deletion of a polynucleotide coding for an undesired compound such as a polypeptide may be achieved. An undesired compound may be any undesired compound listed elsewhere herein; it may also be a protein and/or enzyme in a biological pathway of the synthesis of an undesired compound such as a metabolite. Alternatively, a polynucleotide coding for said undesired compound may be partially or fully replaced with a polynucleotide sequence which does not code for said undesired compound or that codes for a partially or fully inactive form of said undesired compound. In another alternative, one or more nucleotides can be inserted into the polynucleotide encoding said undesired compound resulting in the disruption of said polynucleotide and consequent partial or full inactivation of said undesired compound encoded by the disrupted polynucleotide.

In one embodiment the mutant microbial host cell according to the invention comprises a modification in its genome selected from a) a full or partial deletion of a polynucleotide encoding an undesired compound,
b) a full or partial replacement of a polynucleotide encoding an undesired compound with a polynucleotide sequence which does not code for said undesired compound or that codes for a partially or fully inactive form of said undesired compound.
c) a disruption of a polynucleotide encoding an undesired compound by the insertion of one or more nucleotides in the polynucleotide sequence and consequent partial or full inactivation of said undesired compound by the disrupted polynucleotide.

This modification may for example be in a coding sequence or a regulatory element required for the transcription or translation of said undesired compound. For example, nucleotides may be inserted or removed so as to result in the introduction of a stop codon, the removal of a start codon or a change or a frame-shift of the open reading frame of a coding sequence. The modification of a coding sequence or a regulatory element thereof may be accomplished by site-directed or random mutagenesis, DNA shuffling methods, DNA reassembly methods, gene synthesis (see for example Young and Dong, (2004), *Nucleic Acids Research* 32, (7) electronic access http://nar.oupjournals.org/cgi/reprint/32/7/e59 or Gupta et al. (1968), *Proc. Natl. Acad. Sci USA*, 60: 1338-1344; Scarpulla et al. (1982), *Anal. Biochem.* 121: 356-365; Stemmer et al. (1995), *Gene* 164: 49-53), or PCR generated mutagenesis in accordance with methods known in the art. Examples of random mutagenesis procedures are well known in the art, such as for example chemical (NTG for example) mutagenesis or physical (UV for example) mutagenesis. Examples of site-directed mutagenesis procedures are the QuickChange™ site-directed mutagenesis kit (Stratagene Cloning Systems, La Jolla, Calif.), the 'The Altered Sites® II in vitro Mutagenesis Systems' (Promega Corporation) or by overlap extension using PCR as described in Gene. 1989 Apr. 15; 77(1):51-9. (Ho S N, Hunt H D, Horton R M, Pullen J K, Pease L R "Site-directed mutagenesis by overlap extension using the polymerase chain reaction") or using PCR as described in *Molecular Biology: Current Innovations and Future Trends*. (Eds. A. M. Griffin and H. G. Griffin. ISBN 1-898486-01-8; 1995 Horizon Scientific Press, PO Box 1, Wymondham, Norfolk, U.K.). Preferred methods of modification are based on recombinant genetic manipulation techniques such as partial or complete gene replacement or partial or complete gene deletion.

For example, in case of replacement of a polynucleotide, nucleic acid construct or expression cassette, an appropriate DNA sequence may be introduced at the target locus to be replaced. The appropriate DNA sequence is preferably present on a cloning vector. Preferred integrative cloning vectors comprise a DNA fragment, which is homologous to the polynucleotide and/or has homology to the polynucleotides flanking the locus to be replaced for targeting the integration of the cloning vector to this pre-determined locus. In order to promote targeted integration, the cloning vector is preferably linearized prior to transformation of the cell. Preferably, linearization is performed such that at least one but preferably either end of the cloning vector is flanked by sequences homologous to the DNA sequence (or flanking sequences) to be replaced. This process is called homologous recombination and this technique may also be used in order to achieve (partial) gene deletion.

For example a polynucleotide corresponding to the endogenous polynucleotide may be replaced by a defective polynucleotide, that is a polynucleotide that fails to produce a (fully functional) polypeptide. By homologous recombination, the defective polynucleotide replaces the endogenous polynucleotide. It may be desirable that the defective polynucleotide also encodes a marker, which may be used for selection of transformants in which the nucleic acid sequence has been modified.

Alternatively or in combination with other mentioned techniques, a technique based on in vivo recombination of cosmids in *E. coli* can be used, as described in: *A rapid method for efficient gene replacement in the filamentous fungus Aspergillus nidulans* (2000) Chaveroche, M-K., Ghico, J-M. and d'Enfert C; Nucleic acids Research, vol 28, no 22. Alternatively, modification, wherein said host cell produces less of or no protein such as the polypeptide having amylase activity, preferably α-amylase activity as described herein and encoded by a polynucleotide as described herein, may be performed by established anti-sense techniques using a nucleotide sequence complementary to the nucleic acid sequence of the polynucleotide. More specifically, expression of the polynucleotide by a host cell may be reduced or eliminated by introducing a nucleotide sequence complementary to the nucleic acid sequence of the polynucleotide, which may be transcribed in the cell and is capable of hybridizing to the mRNA produced in the cell. Under conditions allowing the complementary anti-sense nucleotide sequence to hybridize to the mRNA, the amount of protein translated is thus reduced or eliminated. An example of expressing an antisense-RNA is shown in Appl. Environ. Microbiol. 2000 February; 66(2):775-82. (*Characterization of a foldase, protein disulfide isomerase A, in the protein secretory pathway of Aspergillus niger. Ngiam C, Jeenes D J, Punt P J, Van Den Hondel C A, Archer D B*) or (Zrenner R, Willmitzer L, Sonnewald U. *Analysis of the expression of potato uridinediphosphate-glucose pyrophosphorylase and its inhibition by antisense RNA. Planta.* (1993); 190(2):247-52.).

A modification resulting in reduced or no production of undesired compound is preferably due to a reduced production of the mRNA encoding said undesired compound if compared with a parent microbial host cell which has not been modified and when measured under the same conditions.

A modification which results in a reduced amount of the mRNA transcribed from the polynucleotide encoding the undesired compound may be obtained via the RNA interference (RNAi) technique (Mouyna et al., 2004). In this method identical sense and antisense parts of the nucleotide sequence, which expression is to be affected, are cloned behind each other with a nucleotide spacer in between, and inserted into an expression vector. After such a molecule is transcribed, formation of small nucleotide fragments will lead to a targeted degradation of the mRNA, which is to be affected. The elimination of the specific mRNA can be to various extents. The RNA interference techniques described in WO2008/053019, WO2005/05672A1, WO2005/026356A1, Oliveira et al.; Crook et al., 2014; and/or Barnes et al., may be used at this purpose.

A modification which results in decreased or no production of an undesired compound can be obtained by different methods, for example by an antibody directed against such undesired compound or a chemical inhibitor or a protein inhibitor or a physical inhibitor (Tour O. et al, (2003) Nat. Biotech: Genetically targeted chromophore-assisted light inactivation. Vol. 21. no. 12:1505-1508) or peptide inhibitor or an anti-sense molecule or RNAi molecule (R. S. Kamath et al, (2003) Nature: Systematic functional analysis of the *Caenorhabditis elegans* genome using RNAi.vol. 421, 231-237).

In addition of the above-mentioned techniques or as an alternative, it is also possible to inhibiting the activity of an undesired compound, or to re-localize the undesired compound such as a protein by means of alternative signal sequences (Ramon de Lucas, J., Martinez O, Perez P., Isabel Lopez, M., Valenciano, S. and Laborda, F. The *Aspergillus nidulans* carnitine carrier encoded by the acuH gene is exclusively located in the mitochondria. FEMS Microbiol Lett. 2001 Jul. 24; 201(2):193-8.) or retention signals (Derkx, P. M. and Madrid, S. M. The foldase CYPB is a component of the secretory pathway of *Aspergillus niger* and contains the endoplasmic reticulum retention signal HEEL. Mol. Genet. Genomics. 2001 December; 266(4): 537-545), or by targeting an undesired compound such as a polypeptide to a peroxisome which is capable of fusing with a membrane-structure of the cell involved in the secretory pathway of the cell, leading to secretion outside the cell of the polypeptide (e.g. as described in WO2006/040340). Alternatively or in combination with above-mentioned techniques, decreased or no production of an undesired compound can also be obtained, e.g. by UV or chemical mutagenesis (Mattern, I. E., van Noort J. M., van den Berg, P., Archer, D. B., Roberts, I. N. and van den Hondel, C. A., Isolation and characterization of mutants of *Aspergillus niger* deficient in extracellular proteases. Mol Gen Genet. 1992 August; 234(2):332-6.) or by the use of inhibitors inhibiting enzymatic activity of an undesired polypeptide as described herein (e.g. nojirimycin, which function as inhibitor for β-glucosidases (Carrel F. L. Y. and Canevascini G. *Canadian Journal of Microbiology* (1991) 37(6): 459-464; Reese E. T., Parrish F. W. and Ettlinger M. *Carbohydrate Research* (1971) 381-388)).

In an embodiment of the present invention, the modification in the genome of the host cell according to the invention is a modification in at least one position of a polynucleotide encoding an undesired compound.

A deficiency of a cell in the production of a compound, for example of an undesired compound such as an undesired polypeptide and/or enzyme is herein defined as a mutant microbial host cell which has been modified, preferably in its genome, to result in a phenotypic feature wherein the cell: a) produces less of the undesired compound or produces substantially none of the undesired compound and/or b) produces the undesired compound having a decreased activity or decreased specific activity or the undesired compound having no activity or no specific activity and combinations of one or more of these possibilities as compared to the parent host cell that has not been modified, when analysed under the same conditions.

Preferably, a modified host cell according to the present invention produces 1% less of the un-desired compound if compared with the parent host cell which has not been modified and measured under the same conditions, at least 5% less of the un-desired compound, at least 10% less of the un-desired compound, at least 20% less of the un-desired compound, at least 30% less of the un-desired compound, at least 40% less of the un-desired compound, at least 50% less of the un-desired compound, at least 60% less of the un-desired compound, at least 70% less of the un-desired compound, at least 80% less of the un-desired compound, at least 90% less of the un-desired compound, at least 91% less of the un-desired compound, at least 92% less of the un-desired compound, at least 93% less of the un-desired compound, at least 94% less of the un-desired compound, at least 95% less of the un-desired compound, at least 96% less of the un-desired compound, at least 97% less of the un-desired compound, at least 98% less of the un-desired compound, at least 99% less of the un-desired compound, at least 99.9% less of the un-desired compound, or most preferably 100% less of the un-desired compound.

A reference herein to a patent document or other matter which is given as prior art is not to be taken as an admission that that document or matter was known or that the information it contains was part of the common general knowledge as at the priority date of any of the claims.

The sequence information as provided herein should not be so narrowly construed as to require inclusion of erroneously identified bases. The skilled person is capable of identifying such erroneously identified bases and knows how to correct for such errors. The disclosure of each reference set forth herein is incorporated herein by reference in its entirety.

The present invention is further illustrated by the following examples:

EXAMPLES

A Functional and Efficient CRISPR/CAS9 System in *Yarrowia lipolytica*

General Principle of the CRISPR/CAS9 System in *Yarrowia lipolytica*

Since the first publications and patents on CRISPR/CAS9 appeared (Mali et al., 2013), the wide spread use of this breakthrough technique has grown exponentially (Hsu et al., 2014). The use of CRISPR/CAS9 to create genomic modifications in human cell lines dominates the publications which can be easily explained by the possible medical applications of the technique. Use of CRISPR/CAS9 methods in other hosts are less abundant and for *Yarrowia* not shown. This example describes the set up and use of an efficient functioning CRISPR/CAS9 system for *Yarrowia* which uses guide RNA flanked by self-processing ribozymes, one step golden gate cloning techniques and a specifically adapted *Yarrowia* Cen ARS vector that makes it suitable for low and high throughput genome modifications. The structure and function of the guide RNA self-processing ribozymes abbreviated as gRSR in the examples is depicted in Gao and Zhao, 2014 which shows formation of the functional in vivo guide RNA.

Examples 1 to 10 describe the experiments demonstrating the functionality of CRISPR/CAS9 in *Y. lipolytica* using CAS9 in combination with a guide-RNA flanked by self-processing ribozymes abbreviated as gRSR in the examples. The functional guide-RNA is formed in vivo after the self-catalytic activity of the ribozymes have removed the 5' and 3' RNA sequences. In this specific example, a stop codon is introduced into a gene involved in the adenine pathway resulting in a auxotrophic strain not able to grow on minimal media.

Strain Used

ML324: This *Yarrowia lipolytica* strain is used as wild-type strain. This strain is deposited at ATCC under the deposit number ATCC18943.

CEN.PK113-13D: *Saccharomyces cerevisiae* (Δura3, MATa MAL2-8c SUC2)

Example 1

Assembly of the CAS9 Expression Cassette

The CAS9 expression cassette was constructed using the Golden Gate cloning method for combining promoter, open reading frame and terminator sequences described as step 1 in patent application WO2013/144257, which is herein incorporated by reference. Three fragments were synthesized at DNA2.0 and delivered in a standard cloning vector. First fragment is a promoter fragment YI-PRO28 functional in *Yarrowia lipolytica* (SEQ ID NO: 69). Second fragment is an open reading frame encoding the CAS9 protein (SEQ ID NO: 70). Third fragment is a *Y. lipolytica* terminator sequence YI-ter02 (SEQ ID NO: 71). The three separate DNA fragments were cloned by a Golden Gate reaction into the receiving backbone vector 5a (SEQ ID NO: 72). This resulted in the vector named BG-C1 (SEQ ID NO: 73) which contains the functional expression cassette for CAS9. The BG-C1 vector was checked using restriction enzyme analysis and used in the following examples.

Example 2

Assembly of the Guide-RNA Self-processing Ribozymes (gRSR) Expression Cassette with *Yarrowia* ADE33 as Genomic Target The gRSR expression cassette was constructed using the Golden Gate cloning method for combining promoter, open reading frame and terminator sequences described as step 1 in patent application WO2013/144257. Three fragments were synthesized at DNA2.0 and delivered in a standard cloning vector. First fragment is a promoter fragment functional in *Yarrowia lipolytica* YI_PRO07 (SEQ ID NO: 74). Second fragment is a DNA fragment with the sequence for the gRSR (SEQ ID NO: 75). Gao and Zhao 2014 describes how this fragment is build up. Third fragment is a *Y. lipolytica* terminator sequence YI_ter04 (SEQ ID NO: 76). The three separate DNA fragments were cloned with a Golden Gate reaction into backbone vector ab (SEQ ID NO: 77). The correct resulting vector named BG-C4 (SEQ ID NO: 78) was checked using restriction enzyme analysis and used in the following examples.

Example 3

PCR Amplification of Cassettes and Linearization of the Receiving Yeast/*E. coli* Shuttle Vector In vivo homologous recombination in *S. cerevisiae* was used to combine the gRSR cassette and CAS9 cassette into one fragment in the Yeast/*E. coli* shuttle vector. PCRs to create fragments with homology were done using Phusion polymerase (New England Biolabs) according to standard protocols. The CAS9 expression cassette was PCR amplified using forward primer DBC-12192 (SEQ ID NO: 79) and reverse primer DBC-05794 (SEQ ID NO: 80) and BG-C1 as a template. The gRSR expression cassette was PCR amplified using forward primer DBC-05795 (SEQ ID NO: 81) and reverse primer DBC-12194 (SEQ ID NO: 82) using BG-C4 as a template. The resulting PCR fragments contain the necessary homology to each other and to the receiving vector MB6238 (SEQ ID NO: 83, FIG. 1). Vector MB6238, containing a URA3 marker and CEN/ARS sequence for *S. cerevisiae*, *E. coli* ori and an Ampicillin resistance marker for *E. coli* was cut open with PacI and HindIII. All fragments, the PCR fragments and the cut-open vector, were purified with the PCR purification kit from Macherey Nagel used according to the manual. DNA concentration was measured using the NanoDrop (ND-1000 Spectrophotometer, Thermo Scientific).

Example 4

Transformation to *S. cerevisiae* CEN.PK113-13D Assembling the Fragments

Transformation of *S. cerevisiae* was essentially performed according to Gietz and Woods (2002; Transformation of the yeast by the LiAc/SS carrier DNA/PEG method. Methods in Enzymology 350: 87-96).

CenPK113-13d (Δura3, MATa MAL2-8c SUC2) was transformed with the vector MB6238 cut open with PacI and HindIII and both amplified and purified PCR fragments of the CAS9 expression cassette and gRSR expression cassette. Transformation mixtures were plated on YNB w/o AA plates (6.7 g/l YNB Difco, BD Becton Dickinson and Company, 20 g/l glucose, 20 g/l Bacto agar). YNB plates can be used to study amino acid and carbohydrate requirements and for use in this experiment also to test if strains are auxotrophic for adenine.

After three to five days of incubation at 30° C., colonies appeared on the plates, whereas the negative control (i.e., no addition of DNA in the transformation experiment) resulted in blank plates.

Example 5

Plasmid Isolation from Yeast

*S. cerevisiae* colonies from the YNB w/o AA plates were inoculated in 3 ml YephD 24 well plate (BBL Phytone peptone 20.0 g/l, Yeast Extract 10.0 g/l, Sodium Chloride 5.0 g/l, and 2% glucose) and incubated in an INFORS (microtron) incubator ON at 30° C., 80% humidity and 550 rpm. Plasmids were isolated from 2 ml culture. Plasmid isolation from yeast was performed according to a method described in a publication by Kuijpers et al., 2013. This protocol yields sufficient DNA for PCR and transformation to *E. coli*. The plasmids isolated from several yeast colonies were transformed to *E. coli* to further amplify the plasmid and obtain enough DNA for restriction enzyme analysis. One clone having the correct pattern after analysis of the digested plasmid on agarose gel was named MBCAS9/gRSR.

Example 6

Amplification and Purification of the CAS9/gRSR Fragment, Donor DNA and the Hyg Marker Cassette The amplification of the CAS9/gRSR fragment was done with Phusion polymerase (New England Biolabs) according to standard protocols using the forward primer DBC-05793 (SEQ ID NO: 93) and the reverse primer DBC-05796 (SEQ ID NO: 94) and plasmid MBCAS9/gRSR as template. A gBlock fragment was synthesized at IDT (gBlocks® Gene Fragments, Integrated DNA Technologies, Inc) that contains the donor DNA for the desired mutation (SEQ ID NO: 84). PCR amplification of the donor DNA from the gBlock was done with Phusion polymerase (New England Biolabs) according to standard protocols using the forward primer DBC-12197 (SEQ ID NO: 85) and the reverse primer DBC-12198 (SEQ ID NO: 86). A Hygromycin marker cassette (SEQ ID NO: 87) was synthesized at DNA2.0 and delivered in a standard cloning vector. The resulting vector was named CAS159 and used as template in the amplification of the Hygromycin marker cassette using the forward primer DBC-05799 (SEQ ID NO: 88) and reverse primer DBC-05800 (SEQ ID NO: 89). PCR fragments were purified with the PCR purification kit from Macherey Nagel according to the manual. DNA concentration was measured using a NanoDrop (ND-1000 Spectrophotometer, Thermo Scientific).

Example 7

Transformation of *Y. lipolytica* ML324

On day 1, the *Y. lipolytica* strain ML324 is inoculated from a YEPhD-agar plate (BBL Phytone peptone 20.0 g/l, Yeast Extract 10.0 g/l, Sodium Chloride 5.0 g/l, Agar 15.0 g/l and 2% glucose) in 100 ml YephD (BBL Phytone peptone 20.0 g/l, Yeast Extract 10.0 g/l, Sodium Chloride 5.0 g/l, and 2% glucose). Shake flask incubated at 30° C. and 250 rpm.

Transformation of the strain with the PCR amplified fragments was done mainly according to the *S. cerevisiae* transformation protocol described by Gietz and Woods, 2002. Cells were plated after a 20× dilution in YephD-medium on (BBL Phytone peptone 20.0 g/l, Yeast Extract 10.0 g/l, Sodium Chloride 5.0 g/l, 2% glucose) on YEPhD-agar (BBL Phytone peptone 20.0 g/l, Yeast Extract 10.0 g/l, Sodium Chloride 5.0 g/l, Agar 15.0 g/l and 2% glucose) plates with 200 µg/ml Hygromycin B In transformation 1 the following amounts of fragment were used, 3 µg CAS9/gRSR fragment, 3 µg gBlock fragment and 0.3 µg Hygromycin cassette. The amount used in transformation 2 was 3 µg gBlock fragment and 0.3 µg Hygromycin cassette and in transformation 3 no DNA was used.

After 3 to 5 days of incubation at 30° C., colonies appeared on the plates from transformation 1 and 2, whereas transformation plate 3, the negative control (i.e., no addition of DNA in the transformation experiment), resulted in blank plates.

Example 8

Replica Plating of the Transformants to Minimal Media

Obtained transformants were used for replica plating on YNB w/o AA plates (6.7 g/l YNB Difco, BD Becton Dickinson and Company, 20 g/l glucose, 20 g/l Bacto agar) and on YEPhD-agar (BBL Phytone peptone 20.0 g/l, Yeast Extract 10.0 g/l, Sodium Chloride 5.0 g/l, Agar 15.0 g/l and 2% glucose) plates with 200 µg/ml Hygromycin B.

Figure 2:
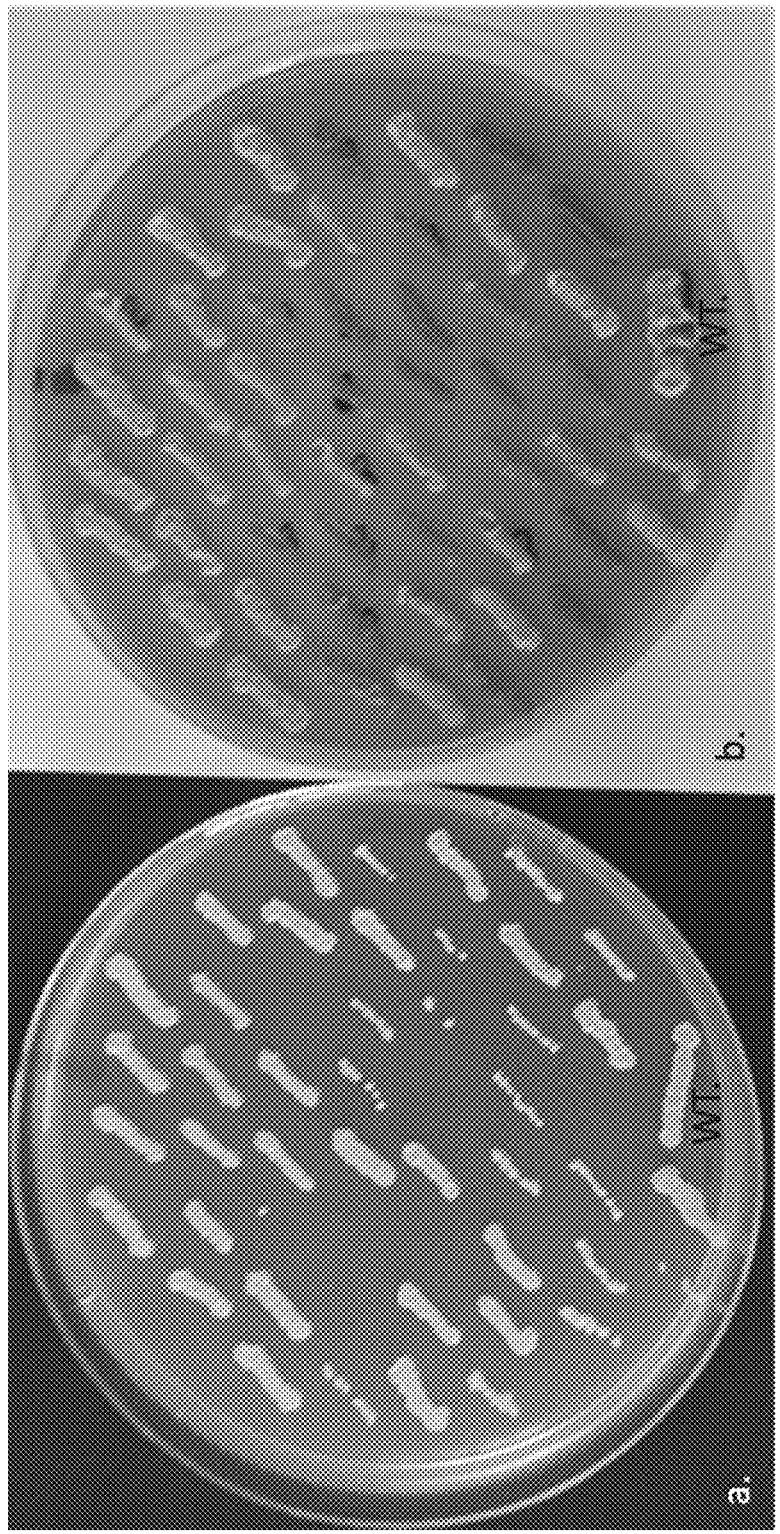
FIG. 2 depicts the results of example 8; replica plating of transformants on minimal media to detect transformants harboring the desired introduced mutation.
Figure 4:
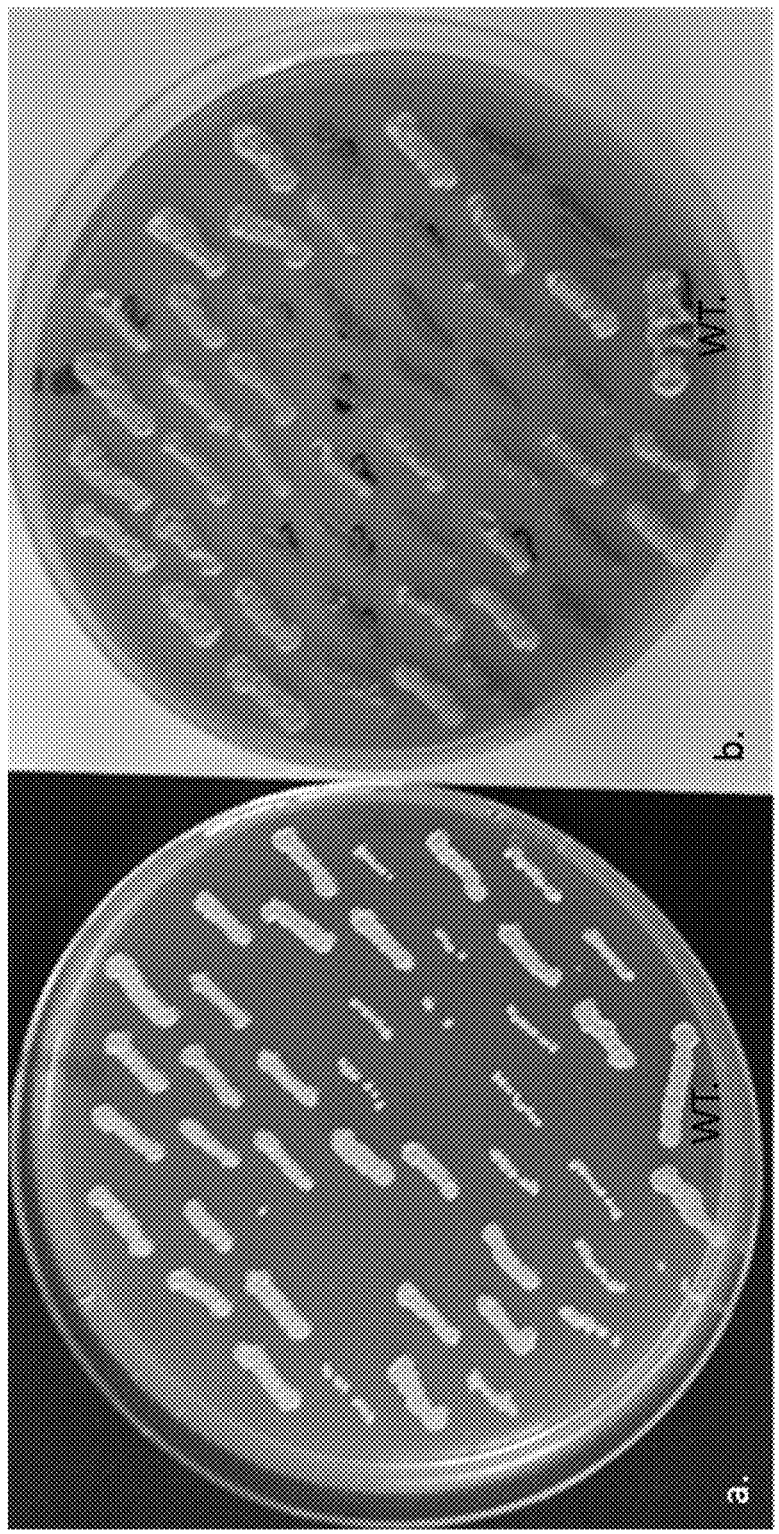

After 2-3 days of incubation at 30° C., colonies started growing on the YephD plates and in some cases also on the YNB w/o AA plates. Further inspection of the plates learned that 4% of the colonies of transformation 2 and 42% of the colonies of transformation 1 were able to grow on YephD but very poor or not on the YNB w/o AA plates which is the expected phenotype after introducing the mutation. In addition a brown colored colony is observed on the YephD plates after a prolonged storage time at 4° C. which is linked to the colonies with poor or no growth on the YNB w/o AA plates (see FIG. 2). The approximately tenfold increase in efficiency of introducing the mutation in the genome of ML324 Y. lipolytica shows the functionality of the CRISPR/CAS9 system. Considering the fact that in this experiment co-transformation of the fragments was used and a percentage of the transformants did not contain all fragments, the efficiency of introducing the genomic mutation in the cells where the CRISPR/CAS9 is present is most likely even higher.

Example 9

Colony PCR SDS/LiAC to Produce DNA Fragment for Sequencing

Colony material of the colonies on the YephD plates were dissolved in a 96 well PCR plate in 100 µl/well 0.2M LiAc/1% SDS. The plate was incubated for 10 minutes at 70° C. The colony mixtures were pipetted to Half Deep Well (HDW)-plates with 300 µl/well EtOH 96% and mixed by pipetting followed by a centrifugation step for 15 minutes at 2750 rpm. The resulting pellet was dried at 55° C. and dissolved in 100 µl TE-buffer. The suspension was centrifuged once more and the supernatant was used as template for amplification of ADE33 sequence fragment. The wild-type sequence is listed as SEQ ID NO:91 and the sequence with the intended mutations is listed as SEQ ID NO: 92 mutation.

The amplification of the ADE33 sequence fragment was done with Phusion polymerase (New England Biolabs) according to standard protocols using the forward primer DBC-12607 (SEQ ID NO: 90) and reverse DBC-12198 (SEQ ID NO: 86). The PCR fragments were purified with the PCR purification kit from Macherey Nagel according to the manual.

Example 10

Sequencing of the Genomic Location

PCR for sequencing was done with BigDye Terminator v3.1 Cycle Sequencing kit of Applied Biosystems according to the manual using the forward primer DBC-12607 (SEQ ID NO:22) and ADE33 sequence fragment as template. Sequencing PCR was cleaned by ethanol/EDTA precipitation according to supplier manual.

ADE33 sequence fragment pellet was dissolved in 10 µl HiDi Formamide of Applied Biosystems and suspension was used for sequence analysis with 3500 Genetic Analyzer of Applied Biosystems (Sanger sequencer).

No mutations were found in the control strains that grew on the YephD plates and on the YNB w/o AA whereas the strains that did not grow on the YNB w/o AA plates showed the intended mutations, namely the introduced stop-codon and mutation of the PAM sequence. Alignment is shown in FIG. 3.

The results show that the CRISPR/CAS9 system was functional in the strains and indeed increased the efficiency of introducing the intended mutations. This knowledge can be used to build an optimized functional CRISPR/CAS9 system for use in Yarrowia lipolytica.

REFERENCES

Aleksenko and Clutterbuck. Fungal Genet. Biol. 1997 21: 373-397. Autonomous plasmid replication in Aspergillus nidulans: AMA1 and MATE elements.

Barnes et al., siRNA as a molecular tool for use in Aspergillus niger (2008) Biotechnology Letters 30 (5): 885-890.

Becker and Guarente, In Abelson, J. N. and Simon, M. I., editors, Guide to Yeast Genetics and Molecular Biology, Methods in Enzymology, Volume 194, 182-187, Academic Press, Inc., New York.

Beetham P R, Kipp P B, Sawycky X L, Arntzen C J and May G D. PNAS 1999, 96, 8774-8778. A tool for functional plant genomics: Chimeric RNA/DNA oligonucleotides cause in vivo gene-specific mutations.

Christianson T W, Sikorski R S, Dante M, Shero J H, Hieter P. Gene. 1992 Jan. 2; 110(1):119-22. Multifunctional yeast high-copy-number shuttle vectors.

Crook N C, Schmitz A C, Alper H S. ACS Synth Biol. 2014 16; 3(5):307-13. Optimization of a yeast RNA interference system for controlling gene expression and enabling rapid metabolic engineering.

DiCarlo J E, Norville J E, Mali P, Rios X, Aach J, Church G M. Nucleic Acids Res. 2013 April; 41(7):4336-43. Genome engineering in Saccharomyces cerevisiae using CRISPR-Cas systems.

Dong C, Beetham P, Vincent K and Sharp P. 2006 Plant Cell Rep 25: 457-465. Oligonucleotide-directed gene repair in wheat using a transient plasmid repair assay system.

Durai S, Mani M, Kandavelou K, Wu J, Porteus M, Chandrasegaran S. Nucleic Acids Res 2005 33 (18): 5978-90. Zinc finger nucleases: custom-designed molecular scissors for genome engineering of plant and mammalian cells.

Gaj T, Gersbach, C and Barbas C. Trends in Biotechnology, 2013, Vol. 31, No. 7 397-405. ZFN, TALEN, and CRISPR/Cas-based methods for genome engineering.

Gao Y and Zhao Y. J Integr Plant Biol. 2014 April; 56(4): 343-9. Self-processing of ribozyme-flanked RNAs into guide RNAs in vitro and in vivo for CRISPR-mediated genome editing.

Gietz R D, Woods R A. Methods Enzymol. 2002; 350:87-96. Transformation of yeast by lithium acetate/single-stranded carrier DNA/polyethylene glycol method.

Goldstein, A. L., and McCusker, J. H. Yeast 1999. 15, 1541-15. Three new dominant drug resistance cassettes for gene disruption in Saccharomyces cerevisiae.

Guilinger J P, Thompson D B, Liu D R. Nat Biotechnol. 2014 577-582. Fusion of catalytically inactive Cas9 to FokI nuclease improves the specificity of genome modification.

Güldener, U., Heck, S., Fiedler, T., Beinhauer, J., and Hegemann, J. H. Nucleic Acids Research 1996. 24, 2519-2524. A new efficient gene disruption cassette for repeated use in budding yeast.

Hsu P D, Lander E S, Zhang F. Cell. 2014 Jun. 5; 157(6): 1262-78. Development and applications of CRISPR-Cas9 for genome engineering.

Ito et al., 1983, Journal of Bacteriology 153: 163.

Jacobs J Z, Ciccaglione K M, Tournier V, Zaratiegui M. Nat Commun. 2014 Oct. 29; 5:5344. Implementation of the CRISPR-Cas9 system in fission yeast.

Jørgensen T R, Park J, Arentshorst M, van Welzen A M, Lamers G, Vankuyk P A, Damveld R A, van den Hondel C A, Nielsen K F, Frisvad J C, Ram A F. Fungal Genet Biol. 2011 May; 48(5):544-53. The molecular and genetic basis of conidial pigmentation in *Aspergillus niger*.

Kornberg R. Trends in Cell Biology 1999 9 (12): M46 Eukaryotic transcriptional control.

Kuijpers et al. Microbial Cell Factories 2013, 12:47. A versatile, efficient strategy for assembly of multi-fragment expression vectors in *Saccharomyces cerevisiae* using 60 bp synthetic recombination sequences.

Larson, M. H.; Gilbert, L. A.; Wang, X; Lim, W. A.; Weissman, J. S.; Qi, L. S. Nature Protocols 2013 8 (11) 2180-96. CRISPR interference (CRISPRi) for sequence-specific control of gene expression.

Lõoke M, Kristjuhan K, Kristjuhan A. Biotechniques. 2011 May; 50(5):325-8. Extraction of genomic DNA from yeasts for PCR-based applications.

Mali P, Yang L, Esvelt K M, Aach J, Guell M, DiCarlo J E, Norville J E, Church G M. Science. 2013 Feb. 15; 339(6121):823-6. RNA-guided human genome engineering via Cas9.

Marck C, Kachouri-Lafond R, Lafontaine I, Westhof E, Dujon B, Grosjean H. Nucleic Acids Res. 2006 Apr. 5; 34(6):1816-35. The RNA polymerase III-dependent family of genes in hemiascomycetes: comparative RNomics, decoding strategies, transcription and evolutionary implications.

Mouyna I, Henry C, Doering T L, Latgé J P. FEMS Microbiol Lett. 2004 Aug. 15; 237(2):317-24. Gene silencing with RNA interference in the human pathogenic fungus *Aspergillus fumigatus*.

Nakamura, Y., et al. Nucl. Acids Res. 2000 28:292. Codon usage tabulated from the international DNA sequence databases: status for the year 2000.

Oliveira et al., Efficient cloning system for construction of gene silencing vectors in *Aspergillus niger* (2008) Appl. Microbiol. and Biotechnol. 80 (5): 917-924.

Ran F A, Hsu P D, Lin C Y, Gootenberg J S, Konermann S, Trevino A E, Scott D A, Inoue A, Matoba S, Zhang Y, Zhang F. Cell 2013 154, 1380-1389. Double nicking by RNA-guided CRISPR Cas9 for enhanced genome editing specificity.

Sander J D, Joung J K. Nat Biotechnol. 2014 April; 32(4): 347-55. doi: 10.1038/nbt.2842. Epub 2014 Mar. 2. CRISPR-Cas systems for editing, regulating and targeting genomes.

Sikorski R S, Hieter P. Genetics. 1989 May; 122(1):19-27. A system of shuttle vectors and yeast host strains designed for efficient manipulation of DNA in *Saccharomyces cerevisiae*.

Ryan O W, Skerker J M, Maurer M J, Li X, Tsai J C, Poddar S, Lee M E, DeLoache W, Dueber J E, Arkin A P, Cate J H. Elife. 2014. 19; 3. 03703.

Tsai S Q, Wyvekens N, Khayter C, et al. Nat Biotechnol. 2014 32(6):569-576. Dimeric CRISPR RNA-guided FokI nucleases for highly specific genome editing.

Wah, D. A.; J. Bitinaite, Schildkraut, I., Aggarwal, A. K. Proc Natl Acad Sci USA 1998 95 (18): 10564-9. Structure of FokI has implications for DNA cleavage.

Zhang G, Kong I, Kim H, Liu J, Cate J H, Jin Y S. Appl Environ Microbiol. 2014 Dec. 15; 80(24):7694-701. doi: 10.1128/AEM.02310-14. Epub 2014 Oct. 3. Construction of a quadruple auxotrophic mutant of an industrial polyploidy *Saccharomyces cerevisiae* using RNA-guided Cas9 nuclease.

SEQUENCE LISTING (124 sequences)

SEQ ID NO: 1-3 - skipped (3 entries)

SEQ ID NO: 4 - DNA, 20550897 bp, Yarrowia lipolytica CLIB122 (residues 1-2,055,090 of 20,550,897)
  misc_feature (805062)..(805161): n is a, c, g, or t
  misc_feature (1509648)..(1509747): n is a, c, g, or t
  misc_feature (1510607)..(1510607): n is a, c, g, or t
  misc_feature (1510615)..(1510615): n is a, c, g, or t
  misc_feature (1510620)..(1510620): n is a, c, g, or t
  misc_feature (1510625)..(1510626): n is a, c, g, or t
  misc_feature (1510628)..(1510633): n is a, c, g, or t
  misc_feature (1510638)..(1510640): n is a, c, g, or t
  misc_feature (1969952)..(1970051): n is a, c, g, or t
  misc_feature (1993008)..(1993107): n is a, c, g, or t
  misc_feature (1993730)..(1993730): n is a, c, g, or t
  misc_feature (1993732)..(1993733): n is a, c, g, or t
  misc_feature (1993755)..(1993756): n is a, c, g, or t
  misc_feature (1993795)..(1993796): n is a, c, g, or t
  misc_feature (7074860)..(7074860): n is a, c, g, or t
  misc_feature (10088936)..(10088936): n is a, c, g, or t
  misc_feature (10711579)..(10711678): n is a, c, g, or t
  misc_feature (10711830)..(10711873): n is a, c, g, or t
  misc_feature (10755124)..(10755124): n is a, c, g, or t
  misc_feature (10755133)..(10755133): n is a, c, g, or t
  misc_feature (11338680)..(11338779): n is a, c, g, or t
  misc_feature (12388623)..(12388722): n is a, c, g, or t
  misc_feature (12655330)..(12655429): n is a, c, g, or t
  misc_feature (14664490)..(14664589): n is a, c, g, or t
  misc_feature (15198478)..(15198577): n is a, c, g, or t
  misc_feature (18230124)..(18230223): n is a, c, g, or t
  misc_feature (18756577)..(18756577): n is a, c, g, or t
  misc_feature (18756579)..(18756579): n is a, c, g, or t
gatgggatgcacattaaacacattgatgggggtgaaagaaacaaatggagcctgaaatgcgtggcctgcctgccatgatgacctggaagtgaatgaaaaatgcacgacaatgggcatacaaaacgcactgaccacctgaccttatcattggtggtgtgtacaaaatcaaaatacagactcaagcacacttcaaaactcgataccgtccagaaaatggaaagagatattacccctgccgcatcagaatatgtccccaccaaaccagatacccccgtggcacgagatacccccgtggcgcgagataccagtggattaccaccactaactcatttcactccggtggagactctccagcacagccaaataagcatggaatcgatcctttccgaggtctcaaacgcgctggaagaatgcgagaagtaccggtggaaagcaccacgtctgtgcctcaacactggcagcatccgcagcattgacaccgactgctctaacgaaacagaggatctatccgtgtctagcggaatcagctccgggtcgattacggaagaccctttttattcacccgttacaacgttcaagagaacattttctctgctatcacagccccacttggcggaggagatcgagccgttggtcatcgtgaagtcgaaaaaggaggcgatctaatcgcttcatagtaatgtactagtctgttgtggtgaattagtatggggcacagcgaggtcccggtaaggtgcacatagaaatgccccctactctggagtaagttcgatagcccacctgacccttgtgtccgtttagctccgatcaggtgaacactgacaaggaacatgggcggtccggctggctgtggaattagcatcgtgcggcgttgtcctatttgtacttgtagctagctactgtagtccttaggttcccctcaagtgacgacgctgggtttaccgttgtctcaagacatgtaaccaatagcgagatcgctggatactaccgataccggcgtcagtcattattatagcgcacggtcacatctgcacacactttgcaaatcccggaattaaaacactgataagaacagggactgacaaagtacagtaatagctacttctataaatgtatgcttattgttatgcataataatcggaggtaaactgagcagtatcaaggtcaataatcatgctttcgatggaagaaaccaagcggtggtcttcttcagcctgtcttatcttcatgataaagccaccttgaccatgtctttatacctcgggacaagtcttattgcaccgagcacatgtgacgtaaaacagacgtcattatagccgggaattatagcgcaacactaacaccctataggccgataccgctagctacaagggacgatactggaaagataagacaaagctcgtctgagctccgacttagtgtagggtagtgtggggtatgcgccgtgcgtagtggaatgccagtgggcagaatgtcgataaggagaaacgagatgtagactggcaaaaaattacacagtctgagagacaattgtatacgtccttctcgccaagatcatttgacataccaagatcatcatctggggactgtttgaaagtctgccaaggtgtgtgtcaatgtcgtgataagggggagacgccaatggtgtgtgtagaacaacctagtttttaaagttcgagccgtgcaagccactggaaaaacatctgacaggctcgacaagcatgtctaggcacgaaacgagaattttaaagcctcctgctgtcaacgataaggagaaaatgtcgattttacgtctcaaatttgctccagcaaacccaggatacctatatacgctcccatgcatgttccacagtgctgctgagatgccggtcagccgtgaaacttaaactatactctatctgccgagagccctatcatatggcttgattgtgggaatacaaccaggagctcgttattgcatacgccaagacaatgatgtgacgccaagactctgatgacactagctagtgccgtttgatctaccgctttcgagttgcggggaggtgttgtgtcgatgggaaatggcagaggactcgctactggctagaatgttgctcggggtctggatacgaacccaatgcagtgtgtatttcacagtatcactctaaagacgagaaagagagtgatgcgttactccatcgtcatttaaagtccaaaacgcaagggtgcagcacaccaagagagttgtcactgggtgtcagacaagagctgggtgcttggcaaactcttggtgccgtgtcatagacccgacttgtgtaagatgtggcttcagtaacgagccagaatgtggtcttagcgccgtgtgatcgtagcaagggtgacaaaatgatactgacagtgatggtatagatagtgtgtagctgagtgattattccctgggtgccatcgatggcctctgtctctatcccacaggaccagctcctaaaagacacccgtactttaccaatacttaccaataatactcttctatacatcatgagaaccccgctgtgataaggctgcacggcgttttcgatagtcggagtctatatggctctatctcgtatttctgctagagctcgggctatataagtcatggattgctctccacatttcttgacatcaatcaacatacacacaatgagcaaacacactgaggttttctcttcggagaaagtctcctctatggataaagacgacctggttgacacccaggttgctgaggtgaccacttcgctcctcgactttgtcgctcttcagctggagattcctccctctgagaacgacggcacgtatcctcttgaagtccacttcatggctgagaagctggaggagactactctagaggaggctatcaagattgtcaagaccaactttgcctaccacgaccacgacaacaacttcagagacgaatacagaatcgaggttagagagctccttaaagtctttgacggcaaagacgactacgaaaaggctgatcctgatgatgttctcatgatgaggtactggggaaccgtcttcaactggtggagtccttaccccgaggttcgagctgttactgatccctacaatgatgaagattgtaccactgagacctggagagtgtgggttttgggtaccgtatgggtggcaattgcggcctttgtcaaccagtttttcagtgtgcgtatgcctgccatctctttgggggctggtgtcatccaactgctgctgtatccttgtggtaaggctctccagtatgctcttcctgactggggcttccacttccgagggaagagatactcactcaacccaggcaaatggagtcagaaggaacagctcctcaccaccatcatggtttcttgtgcctctggaactccctatattacttcaaacatcattgttcagtacctccctcaattctacaaccaaacctgggcctcaagctttggataccagtttgtttttatgctggtgacccaaatgctaggttttggtctggctggtattctcaagcgtgtggccgtctaccctgtcaaggcaatgtggccctctctactccccaccctggcggtcaacaaggctcttctggctcccaaccgaaaggaaaacatcaacggctggctcatttcccgttacacctttttcatgattgtctttatcggctctttcgtctacttctggatccccaactacctcatgaacttcttgcagacatttaactggatgacctggattgctcctgagaacgccgacctggccattgtcacaggctccgtcggaggacttggatttaaccccattcccacctttgactggaaccaggccacggcttctcttgctcccatcactctgcctctctatgtgtcttctattggtttcgctggcaccttcttctccggtctcgtcatcctcgctctctactacaccaacaactcgtggacgggatacatccccattaactccaaccgactgtttgacaacatgggcaagaagtacaacgtatccaagattctcaccaattaccgattcgacgacaagaagtaccatgactactccacgccctactactccgctggtaacctcatgttgtactcggccttctttgccgtctaccccctgtcgtttgtctacacttgtctaatggactggagagccatgtgggatgccctcaaggacacgggaaaggctctcagatacgtgcatcgatcctcctaccacggaagagaggaccccttctctcgatacatgaagaactaccccgaggtccccgactggtggttctacgtggttatggtgattatgtttgcactatctattgttctcgtcaaagcttggcccgttgacactcctgtgtggactctggtgtttgtgcttggacttgtgttcgttttcattatccccttcaccgtctttgctgcctacactgcctcctccttgtcactgaatgtgatttccgagctcattattggatacgcgcttcctggacgattcatggctctcaacctgatcaaggctctttcagtcaccattgcctctcaggcccagaactataccaccgaccagaagctgacccattatgcccatctgcctccccgatctatcttctggctccagctgtgggctactctggtcaacggtctggtctgccttggtgttatccagttccagctcaacctagacggtatctgtgatgctgataacaagcagaagttcacctgccccggagaaaccactttcttcactgcctccgtcgcctggggagtcatcggccccaagaagatgttcgacaagtaccccgtgatgaagtggatgttcctgtttggagcgctggccggcgtctttttttggtttgtccaggtcatccttccccagatccttgtcaagtacttccctaacaaggcccaaaccattgactactaccgacgaaagattctgtacttcaaccccatcatctttgtggtcggctgtcttggctgggctccttacaacctcacctaccaggtcggaggcatgtaccttgctgtgcttttcaatggctacatcaagagtcgatacctggcctggtggagaaagtatgcctacgtcatggaggcagctattgtcaccggtattgcgctggccggcatcatcatcttctttgcagtccagtaccatcccaaggacattgattggtggggcaacaccgtcatatacgatggcgttgacggcagtggtatccctcccagacttgagatccccgagaagggattttttggccctcctagctccgaatggtagcttctaacttatgtacgataatattatgagattttgattgactcacaggtagaaatgtatgagaaggtccagggtagctgagaggagactctcaaacggacatgtagtcagttcaagtaaatatcatcgacaacccgttatcgagttgcatgtgcagagaagggatacagaactgccaggagcagaaacaggtgaaataacatagccaaagacatcctcaacactgtcaaaatcatgcaatgcctcagattgtccgagttattcacttttccagctcccacatgtcttctcggcattagtcatcctaatttacaaaggattgtacttctgtcaaggacggctcatacactaccaccacagtagatatactatcgcgacctcataatattgtccccgccgaatcattttgataccaacatatatcataacgcgttacgcctcgcagtgctcatttcaacttcagcgcatcatccatgactggtgcaaacacaccagctgtctggtaacgattgaagaccccaacaatggcaataaaaccaactcgaccaattagaccaactagaccaactcgacgcggaatttgagcaatatcccacctttacaaccccatcgctcaaagacaggttccccgatatctatccgaagattcccttcggagtctcaaatacacgcagtatttcacctaaaatagaacatgtaggcatttttgggtgggtaaaaacagtacacataagggtaaatgaccacaaaaatccctgaacaagtgcccatttcccaccagtggctcgattccgcccggatcaacttcttcccccaaatctccacctcttacagccatgcaccccattgaaactctaaatttttcactgctcgggactgaaaaatttcatctacacaaaaataaagtttgtaaattttcactgtagcaagggatctttgcggtcgaattacaacgccgcgagacatggtgttcttggacggtgatgcaggtggagccacgtgaccagtagggtggatctgcatctgtctgatccgagctgactaatcaattgcggctgtttcggcagatcgccgtacccgggtagcgttagactaggaccggtctacagctctgttacactgttgtgagatggggtaagcaagatttggctggttgcaaggttgcccggaggtgctagggaggtaatacggtgttgaatggaggttgtaggacgttaaatggaggttttagggcgttgggtggcttgatttttgctttgaaaacagatttcaaacactacgagtgaattccagcgttccaaatccgtgtataagatgcctctacaggcctatacctctcttatccaccctcaacttcggtgcagaaggatgaattgagacgggataaaaaaaaacagtttaaagtttgtcgagaaactcaatcctgggtctgcaggcataacgttgaagagcggcatcatgtgacctgtgtgggtgaggagcacagatgagggtgtccagaaagtgacgatggaggtggattttgcgattgcaaatttttacccaaggaattgacacctagctactgaatagtctctactcatattccccaaattatgacccgaagatgggttacttggggtcccccgtctctccacgtgcatggttacccggcccaacatgtcacccgattgggatgaaaattttttcactgcaagagctcatatttagtttcgctcttccctcttttcactaccaccttaccttgaaaccctcaagtataacaaaatgagtgaaggaacttttgctggagctgtcggtatcgatcttggaaccacctactcgtgtgttgccacctacgactctgctgtcgagatcattgccaacgagcagggaaaccgagttaccccctctttcgttgccttcactgaggaggagcgactgatcggagatgccgccaagaaccaggccgccctcaaccccgtcaacactgtctttgacgccaagcgactcattggtcgacgattcgacgacgagtctgtccagaaggatatccagacctggcccttcaaggttgtcgacaacgccggtgcccccctcatcgaggtcgactaccttggcgagaagaagaccttctctccccaggagatctcctctatggttctcaccaagatgaaggagattgctgaggccaagctcggccaggctgttgacaaggctgttgtcaccgtccccgcttacttcaacgacgcccagcgacaggccaccaaggatgctggtgccattgctggtctcaacgttctgcgaatcatcaacgagcctaccgctgctgccattgcctacggtctcggtgccggtaagcaggaggctgagcgacacgttctcatcttcgatcttggaggaggaactttcgatgtctctctgctttccatccagggcggtgttttcaccgtcaaggccaccgctggtgacacccatcttggtggacaggatttcgacaccaacctccttgagcacttcaaggctgagttcaagcgaaagaccggccacgacatctctgctgacccccgagctctgcgacgactgcgatccgcctgcgagcgagccaagcgaactctgtcttccgtcacccagaccaccgttgaggtcgactctctcttcgagggtgaggacttctccgccaacatcacccgagctcgattcgaggacatcaacgctgccctcttcaagtctaccctcgagcccgtcgagaaggtcctcaaggactccaagatcgacaagtccaaggtcaacgaggttgtccttgtcggaggttctacccgaatccccaaggtccagaagatgctctccgacttcttcgacggtaaggccctcgagaagtccatcaaccccgatgaggctgttgcctacggtgccgctgtccagggtgctatcctgaccggccaggccgtcggtgaggacaccgaggatctgctgctgctcgatgttgttcccctttctcttggtgtcgccatggagggtaacatcttcgcccccgtcgttccccgaaacaccaccgtccctaccctcaagcgacgaaccttcaccaccgtcggtgaccaccagaccaccgtccagttccccgtttaccagggagagcgagtcaactgctccgagaacaccctgctcggtgagttcgacctcaagaacatcccccccatgaaggccggcgagcccgttctggaggccatcttcgaggttgacgccaacggtatcctcaaggtcaccgccgttgagaagtccaccggccgatccgccaacatcaccatctccaactccgtcggaaagctgtcttccgaggacattgagaagatgatctccgacgccgagaagttcaagtctcaggatgaggccttctccaagcgacacgagaacaagcagaagctcgagtcttacatctccaccatcgaggcctccatcaccgaccttgactccaagttcaagcgaggtgctaaggacaagatcgagactgctctctccgatgccatgtccgcccttgagattgatgacgcctctgccgacgactaccgaaaggccgagctcgcccttaagcgagttgtcaccaaggccatggctacccgataagttaagtctgtgtagacacccaaaatatccttgtatgatgaaaccaatgaaaagcgtagagaggcctcagacttgaaaatactgtctcaagtgtagatggcctggcaacaccgaagtcaattggacattgtaccggtctaaggcgatactagaacacatcacatcacaggcacagacacagacacaggcacagatacagacacggatacaagatgcgcgatatcgcacgatcaagaacttactcgatcgtatggcttcaaggctgtgcctgtgtctagggtccagcatgtagtagtgtcattgagtgccgtcgggtgtcctgtgctatatgaagatttcctgtgctatatgaagaaggaaagaaacaggtacaagtaggatgaagtacttgtaattctcacaaaaccgagtaggaattcagggttgatctagatgctgcatcaatgtcatctcatgtcctacaagtaggccatcatggaaggaggtgagtaggactagaagcctggggacatcccaaaaattgtcgtccttgatcatcagtgtccattggggcgctccgttcaacaggactcaagataaccaatctgtgagacacaccgacaaccagagggccccatatttgtacccaaaatccacttatttctgctttttaattgtagttgaaatcaaacccgtccaggactcgaactcacacgacgcaaaaaatgtgcaccttttttttttttttttttctgcaccaatatcgggtcacggaaatgtggtgaagtaaacctaatgaagaagcgaggacgatcaccattgtgtgcccaaaagccgctgccgcggggttagacacaagacagtactaccgttcgatagccctggctatggagaaggtctccacgaggtttgtttccccatatctcttctcaaacctcctgtttctttcttttcccgcgagtgactcactctaaaccgagttggattcccgctgtcggctcgtgatatgccattggccgtcttggtcttgccttgtcttcaatctgactctttaggtattggcatcaaagtgaaatcgtccacattcgtctgagagaaaactggctacgatcatcctcaaaccatgttgacagctaaacctaagcagagagacgcaaagggacggccagaggaggccctatgtcgttgctatgatagctgccggaggcattaaagcagctgttattgaatccatatctccggcgttttgtctctccctcctgcaatgatctgataccgtcagtctgtgttttgttctgccaagagccccttcccaatgctgccaagagtggggctggatacaacccacatggctggctggtttgaaaacgatcggccgctcgagcgaccggcgatggattagataacttgactgtgcgttaatctgtgcgggttgaaactccacacgctgcagcaacagttaatacaaggtcggaatatgtgcttgcgataggtgcgtgccgtcatgtacatgtgcagcatgtgagcttttgcgcactgtagaaaccggtccaagccggtgaacctacggcttgtttattgcaggcgttagatgctgtcggtgagttcttttttcttttttttggttggtcctcaacggtgtagtacgactacctggagctataagacacaccgccaacactcttattgtgatacgctcactttgattggtggatggtaattgcacaatatcacctccgactcacccgattcacgtgcttcctgttgtcccgcacctcgccaaatgtcaaaatgtcaccacagacaaagacgcaaagttatctgattgggctgcagccaacatcaccagtggttatccacgagacgttgacgcatcgtatagccacaagagatgagctactgaacctcaaaaacctcgctactagcctccctatcctctctcgcttccctcgcttgtctaacttgtcctgaggtcaccgttacacctccatctatagctccaagcgtccctttacggcctcattgtgcgctttcctttttgctctgcaaccttatgagtttattcctagtggtgccgcgtgtgtagagtgacagcggaagctgttagtgcatctataagatgatggctagtttggtagttgattgagtctttggggctggcagaagctgtccagtcgttgcccgcaactcctgggtcacgttaagaagagcacaggaatacactctgaagagtttcgaagcgaatttttcaatggcggcccctcctgcctctttcacaactcttggcgctcttttagcagatttcaaattagctctgagcgtgcattttggctcaagcaatctcatgttgtcccatttatcagattgatcagaagatgggtgaaactgcgagttggaaactacaacaagcgtccagacgagcaatgagccaatcaaaacccgatcacagcaagatcgaacacgagcacagaccgctaaccccattgaatccccgtctcggaactccgttagccgcctttgccgtggtgtgaacaagggcagaacctagtcctgttgtacatttagtccccaacacgccaagaagaaggctaaaattatctgattttttttattatcaatttgatcacccccagaagacgggttatatataccgctcgtagacccgataaaaaaatagcctcccatcttctcagcacacaatgaagctctccaatatctttgccctcgcaacagtggctctggctgctccccagcctctgattactcctcctcctactgctgtcgagaagcgagacgaccaggctgttctcggagccgacgtctggatccagaccatgcccaacggccatgagaagcgagtgacccccaccatcattgacggagtcaccatttccggcaagcccctctccgatcacaacggtacccccaccccatggaactctctggacaacaccggtatcccttaccgaatcactccctccatcaagaaggagaaggaccagcccgccgagaccatctctgcctctccttccccccctgccaactaccctcagtctacggacactcctcccgttcttggatgctggggagaccgtcttcccgaggacaacgagaagctccccggctaccccttctgctctcctcataacggtaccgaactcgttgccggtgagacctactgggtcacctgggacccctcttactggggaggtgatgacattgctcaggtcaagctgattctgcgatctttgcctaccggcactgacgatcttatgttcgagactgagcccttcgccaaccgaaagggttactaccccctggagattcagcgatcgtggaccaacaacggcggctacttcttcatcaacattgctcccctcactcgacctgataccaaggccaagaacgtcggcaccaagtctggacctattgttcgggctatcatgagcaagaacgacggcatcaccaccgtctcccgacttccttctgagaactctctgcagcctggcaagaagcacagcggtggaggaatcggcaagggcggaattgctgccgctgttgttgttcctgttgttgttgtcatcctcctgtccggcctcggcttcctctactaccgacagaagaagaccaagcagcagcaaatgtctcaggaccgatcttggaaccctgccgagaacgtgcgaaacatggactccatgcctcctcgacgatcggacgtgtctctggaccgaaccatctccatcgacacccagcactccatgaagggcgacaacccttttgaggaccaccactaagtgttggcatgtgcgactgtatgactacaccatttgagattcactcacatttttaaaatataaaacggcgatgccttagtaatgatatttatgacctaacaactgattgtgcacgtagacgagctggatttttacaactgtcagtgggtgcgtaccgacataccccacagcccagcatgatcaccaaccgaaccagtgagtacctctaactggttctggtcacccatcttagttgacggagacagatgacgaaactggacaagcagattccaggttttcccctttttggcccccgagagaacttcatagaaaggttcgttaccactcagagagaagcgggacggtgaatatattcccttttctatatcatacaagcaggtattggagaagtttagactttctaggccattccaacgcgacatttacacacaacttggtgcgagaatgtccaatatggctaaatattagggcaacgggacactttcagtgtggtcaaggttattagtcccggtggttcaaatatctacgagtactggaccctcacaggagtttgagattgtttccaaagggtcagagtggccagtcttcagacaagaccatcaagtgattttacacattatccaagagtatcgcccggaagaggagacctgtgggatcaatataagaccatatagtgattgaattattcaacgataggcaagtctgaaatcaatatgtttcattcgtcagacgtaacaagtgttagggggacctgttatgttaatcgcggaatggccaaagatgaaaaacgagaaaacatcttacggatcttgttcagaacttcccgagttcgaaatttctgctttttcagccctctccgatataccagagttcagctataggcttcagctggtggcagaggagtatgagtgatggtatttcgttttccaggagtcttgccgttgagcagcaaagggtttgttgtcaatcagggcacgcagaccggctagctcgagagtggatacaagtgcttggttcaatagctcgaggttcaagaatgtatgtacagtagatacttgtattttacaagtagtatatatctcacgacaacatgtacttacttcagatattggttgtcgattactaaagtctcagttacttcactctgatacacctgggataccagccttgtccaggttacctcccgcatccaaaagagcatggaccctgtttctggatacttcatcacttcggccacacccggccaagatagccgagtacggtcttctagaaagtgattcaagaccgaatggtcaagtgtcttactggcattgacgatcccgacattggtctcggcaactacggtatctctgagcatgtctctggcttcatttcgacatattcaacaagactgacgacagtaaccagccgattgcgccgctaaggaaccaactcaggcgttgttgttggctgccggtcgggctcctagccagcccctcaccaagaagggagtcatttgtctggtcttacgtcctttgtacagatctcaccccaattgagcgcggctacggactagcaactgacgcagtatacacccaattgctggatgtgcttcattgacgtctagctccgagcccttgccaagttatcgtctacaagtacatggtatgtacattttgtactgcatacactgccacacctttatttcgttatttgctcctacttttacatgtcactgagtaaggatagggagtttatagacctggagtggacctccatcagctctaccggctcccaatgcctataagtacgagcatgttactagaatggactactcaaatgacttattctggactcagagttgtgggttggtataccgttgattcaggggtcaactctccggacagtacaagtacgaagctgaacttcggacagtggtatatctgcacactgcctcggtacttgtacgactacaagtatcgtactactgtaagtactttacccttttaaacctcatattaataaatcccacattttagacccccctttcgcttaccaccttgcacccacctcacacccacttcctcccacctcctccctcgcacccacctattgaagtagtgacaccagggtaataaaagacacacggttgttatgagcggaacccgggctttccaattgtcccacgtttggcccgtttctccacttcctcgtcgcgccaagatgaccctctgcgcttgctctcatacttgtgggacagtatgcatcgtgtcacatgtgggcaaagaaagatatcgccaacacgcatgttttgcatgtataacacgtcaagtttacgcgacgtgcgtactgtacgaatatgtacgagtatgtacgagtattctacttgtaatatattgttggtggaatgtggactattcgtatttgtactgatttggcaagggaatgtacatattaggaggtaggggtgagtgggtcatggttggtgcaacatcaggcatgtattatacatactgtgcttgtagatatcggatcggatcgtgtcgatctgtagatcggtgtaatacgatacggtagccatgtactatccttgactggcgcaatactagtacatggcgcgcaattggcttaatgctattaccaccacaatcactaccacaatttcgattccgctggcgtctcctcaatacctccccaaatcaggcaaatcaggggtaactcaccaatgtatcgctccgggttcctgctttgttcatgcccccctggacgcatgtgcactggcactggggggctgcaattgataatgaggaaaatgaggtcaagtggtgtcactcccatcggttcggtgtgaatagctccgctggttcagtgtgaatagctccgttggttcggtgtgaataggtctgtcggctctatcaaacttgaactgccagttgaaacttttgttaatgtttaattggcatgtttggttgaccgctgtgatacggaacactgccattaattacgtcattcggccgctccacacaccaccactccgccactcggtactcacactcctgtaggtggcttcccgtttcacaatattattaatgtactaacacaaacaaaacacgaagctcccccccccccccccgcatacatctatataaccccctaatgtccttcataaaacccacagtcactcgttcagtcattcattcactcttttttcaatcccaccagcttgcaatgaaactacccatcattgccctcgctcttcttctctcctcggtggtggccgaagtcaccgaggaccaggcggtcctggacaccctcacggcccccagcatttccaccagcaaccccgcagcaaacgctcttctggatcttctccaagagcaggccggtgttctgagcaccaaaaacaatggtgctggcaacatctccatcgatcgcaccatgatcatcggctacgccagcaacgaccctaactcccagagccgattgcctggtttcctcagacgacagcaaatgtacggccagcaccagtgggaatccacctgtggacctgaagactggagagatatcatttctctcgacaacccccagtcggtcaaggaagcctacgactggtacttttatgaaattggaaaacacgagcctcagtacactgatctcatgtacgaacagaccgtctatgacgtgtacatgatgtgggctgcccagaatggtgccgacgaggctgagcaaacaggctcagagctgattctcaattggcctcctacaggcacttgtggagagggctcctctgctgaatctgattcttcctccgttgaaccctctggcgcttctgatatgcctgtcactaccgattacaccaacactcatattcctctcgagactgaggtcccttctattgagccttcggttgagccttctgccgagcctacttctgagcctgtctacggaagtccttcagttcagccttccgtggagccttctgcagagcctacttctgagcctgtctacggaagtccttcagttcagccttccgtggagccttctgcagagcctacttctgagcctgtctacggaagtccttcagttcagccttccgtggagccttctgcagagcctacttctgagtctgtctacggaagtccttcagttcagccttctgttgaacctactgacgcccctgtttccaatgagacccctgcttccactgatgctgcttctgtcgagcctacttacattccatccgttgagcccacccctacccccactgataccgagatcgatatccctcccgctactgacagctcagctgccccctcagaccacccctccacagccgagcctgatttcactgccgctcctaccgctacttccgctcctgttgagctcggaaccactctttctgatgtccagaccaccctagactcactgctgaccaacatgcccgactctgctgaactcaagcagcttgtcagtgatgcctctgctaccctggctagcattgagagccaactttctggcaccctggctaagcgagacgaaaaggccgatctggcggttaacgtagctacccttctggaacagctcaaggcaattgctgctcttgttgagaccgtggaggacaagtccgccgagctgcaggctgatctggacaatctcaatgctcagattgctgagctggaagcttggctggatgagaatgcccccgaggtcacctctactgagactgaggctcctgttgagactgcttcggagacggcttctgagactgacgctcctgcttctgagactgacgctcctgctgagactgtttctgagactgacgctcctgctgagactgtttctgagactggcactcccgttgagactgcttctgagactgactctccttccgtcactgaagctccttccgtcactgaagctccttccgtcactgaagctccttccgttaccgacgctcctgtcactgactgtgagaccgacctcgtgtcttccatccctgctaacatctctgccccccttgtgactgagattgagaccctgtccaccactctgaccaccacccaaactgtcacatactgcgaggaggagaacgtttgcaccaatactgttgtcactctgacaacctgtgtgcccattacccacaccgtcaccgtttgtgacactgtcattgatggcaagaccgtcaccgtgactgttccatgcgaaatcgagaccgagtacgtcactgccgaaaccaccgttgttggcaccaccgagattgtttctcagcccgttgagaccatccccgtctctcagcccgttgagactgctcctcccgttgtcgtcgagtccactcccttcaacaacatctcttggaccatccagtccactaccgcccccgccacagccccagtccctgttgagacctcccccgtcaccgtcgagactcttctgaccacccagaccattgttgaggaagattataccaccaccatcaccggaaccgtcgttgtgacccgaatcatcgtcactcctacatctactcctgctgtcgctacgccgcttgagcccgttcctactcctgttgactccactcccgttgtgcctgttcctacagccgccaacatcactgagattctccctgttccttcgaacccggtccagggtaacttcacgacatttgtgcctattcctacccaggccaatatcactcagtttgtgcccgtgccttccgacgtcacccaggctaactctggtaagaagctcaccgtcggagctctcattctccttcctctactcatgttgtaatgtgctggatcacagatgtactaacagacttaatctccaatataactctcaatgccagttatttataggtaaagcagagcacgtaaacctgttggatgagatttctctctgatattttcacaaaatattcccccagtaattgagtaaatcccgaaacaatattttaggatatgttttcctatattttaggtaaaaatttcaagattaggcgaactgtttggttcaaagcagaatatataacggatattatctgtggatctactcgaatctcgaaaaatccataaatcatcatctccatattgtatgactaatttaggaataccgagaagcccgtgtttcgacgccagtcatggtttttctcatcatcccatttggtcactgtcaatccctgagcaagctaaaataaaagccaacagtgcaaaaaaagtgcccggagcacagcactgggggttgcacaagatggagattcctccataaccaaaaagaagcgtctgactcgcacacgtagtttggggaacgtgaatgagggttgtgcagatgtctccatggagacgaccaggtggctgctctcacgggatatgggtgttctttccaacactccgctgcagcatcaccatctactagaccctgacctatccgtcgttttggacgaactaacagccatagtgagccctctgcttgaagccagtggagggataacacatccattctgatcagaagaagccctcaaaatccatggagtgggcagtggcaatcatggcaattgcagttgtaggtgtgcagtagatatgtcctagactgcacagaaagatgccacagaggtagtatgatgagaaagaagattgagtagggagacatagtatagacactgtcatcaccagatgtgtacttttgttgtccttttatactcaccttattttacattatatttcccgtattactgtaataggaaagaggcaaataaaaaataaaattgtacctccccagtacaatacatgaattcttatcctataatatactgtataacgtatgtactgtaaaatatatatgattggcgatttgttaaggttgagataatgccatggagtgcataatcgcaactctgttgggaagttattaatggtggagtaaattgtaaatggccgcaaattattctaatgatttatgtatatttatttgttgataatatctgatgtccgttgttttccttttttcccgattttatagtatatattattattattattctgatttcggatataatgggcaacagaaataggtgtctctggaaaaggcttagagatgtcacattgagaataagagcactttccaatgtttatgaggctattataacatccaacttgatgttggtgatattagaaggtgttctagagagtgtcattcgctaagtgctgtagtaacatagtcagcacaaataattgagtttgttagtaaggcacactggtcacattgacatttttacatatggaattatatggaagaaatgttcttttagagggtgtctggcacgcacttccatggcacataaaacatcttcgactactttgctatcatataaccaataaattaacgcaatctatgttttgggacttgaagcagtgtgtggaatatgatatccatcatgacttacagccacttgttgctgtttataggtattggaagaagtagtagacaccccaggctgcccagtttctctccctgattaccgcgtataccccgctcgaatggtcgtcattccactcctgcagcggtgcgaaatcctcgctctcctccagcatctgcttgtacttggtttggttctccagtcgggcatccactacaaacgccatcatgtaagagacgtacagaaccgctgcaaaaagaacaagatagaaccaagctgttttgaaaagcgccacgagaccagaagagatgagggtcgataaaatggttagctgtttgctcttttcgatcgtctcatagtactgggactcaggcagccaattggaagcaaaaaacgcctcggaccacttgatttcgttgacgagaaacgagttgagaagtagaaccagcacaaaagccgcaggatgtaccgacagtagccaacactgacagacacccagtagtaatgtagacgccagaagaatggctgctgtaaatatgtaaggagagacctgaaagagatgcaattgggcagcggaaatcttggggggtgtccacagaggcaggattccggctgccagacatgccaccagctccatcacccttcttccctgctctccaggactcagattctggttttgaagacggtaaattgtcactgtgagtccagatagcatcactccatgtcgtagaatcatgctgaaccagttggccattagggcgggtagaagggtgtgagtcaattgctgttgcgtgtcctcttcgttatttaacatggccgagacttgtgatagtactgtagatacacaaggtggtttcactgtgctgaaagctgtgcctgaacgcgctcacttgaaagaaagaaaggagtacatgatgcggctatgtacaagtatatggtttgggacgtcacgatggttcagggaggggtttatttccctttctcggctcaataagagtacacggggcctttgtttttgtcacgtgattttgatatttcgtttttgtcgcgaatttttgtcatcagacaattgcatcattgtctccttatctcgctttctagcagcacagccatgcactccaccagatctatatgatagagttcagggatgaccacagggggaacggagaacggggtgtgggatatcacgtgaactgaatctttgcgtggtgtcgatatgatttttttggcggcgtttgcgtctgcaggactacgatacaatatcaagtggagggcatctgtctcttacattgatttttgtgggatatttggagctcagtcggtattctggtgactccaaagctttgaataatgtatgaagtgagatatggaactaagggttaataatttgttaacaatcagagtaattaaagtagttctttctacgtactgtactgaatagatattcttgttttcaacgatattgtcgttcgctttggtagggaaaatttgttgactgttagcagctactttgtcattgtgcatcgattctgaaaaaaaggtctttaggcagttttgattttggggttcgctggatacaatacttattcaagtatgtcctttcccccaattttattctttttttttgtgtgtttttttttttcctcttttttctcttttttctgtaagactatgttttagattttcctttttgttcctttttttatttttttattttttaattattttatttctccaattatgggttcgaatcccgactgactcagtgctcctcctcctctcctcttccatctatttaaggttcacactaaacatacaccaaggccattatatataatggttaccaatcagtatatattacgtcactgccgccagattttgcccccgctcccgtcgacccatgaaactgcccacggagattgtcgcccagatatgcgcgtcgctcgaccttgagtccctgctccagctcagttacacaaacgccagactgcgggcagtggcctcaaatctattccaacaaaagatccaagcgagctggccctggatcacggactgctccgactggtaccaagaaggtatcaaaatcgtgctggcgagaagacgaatgcgtgagaagagccccatgagcgaagaactgcctgtggtgcaggttgccagacacctgatccatgtgaacgagcctgtgcctgaggaagcgattctgttgggtccggaaaccaagtacatggacgacgaccacgatctgtatttccgcaccgcttctctgacccgaatcaacccccgcaacatggccaatccgctgtcgtaccacgatcctctgtgcatggatgtggacgactttctgcagctgacaggcaccaagaacgcacacggaaagacgatagtgacacacacatttatggggagatattggatatttgcatacgacgagggaggaggggtgctcgaggccccaaagctcgctgctattgataactggatatactgctactttcagacccgcgaagacggttacacggttatcaagcaccattgcatcactgatggcgtcaaagatgtccctgactatcttgtatcgcttgcaaaatcggaatacgggtccacttacgaccttgactttttcttttcgcgcgaaaacgtctttgtgatcgataaactggttttcggaaatgaggacgacttcaagcctgtctactttcggcttttgaatatggaaacaggcgccacggtacccctttgttttgtggacaagtcggatacccatgtggtggagtatgaggcgtttgtggactacatgcggtacttgtggctggatgggccgttcttttacatctactcgggtgccgacgagatgattattgtggtggatgtgaaagaggggtgggtcaagtatttggtgctgacaacagagatatcccatgagtcgcacttgagtaggttgactcatggcttgttgtggctgtacgacaatcttgtggtcgatgtcaagaggcacacggttcattatttgcccgataacagcaggtgcaacactgcagggttgtataatgggcaagttcattggtggaggtttccgaaagccgacaagttggtgaagaagcaggaattggagattggagagggggtgtctgtgttatagctagtgctgacggcgtgagcgagaccagctgaggacactatttggctactgacacagaccgacatcttgactaacataaggctactaacaatctctctgcaggacaatttgggtggtgagtgagatactggttcactacagaacacaattggggagggtggaggactggaggacagactgacgaaggtagatgcggagcctgagagcttgtatctgagtgtactaacgattgtttatttatttattcttgataatcacttttttgacccctactattcaggtcctctaatacatggacatgactaccccttgaactgtcgcagcagtggtcagaagcgggaaatatttatatcattggaatccccgaggtcgtgtttcagtacaaaaatgtcttttattttccacaaatagcggcttctcgcgcagttgtggtggcccatacttgtgtaggattttgctcacacgaccaaaaagaaagccacaatcgttgaacataaatggagggaaaaatcacgagttactcagacaagttactcagacaagttactcagagaggcaaaatataatcggagagggttttttggggctattttgagggcaaaaagagaggacgacaggactcgaacccgcagcctttggaggacgtcgttcagaagaaccgaaatccaatgcgctaccattacgccacgtcctcagaaaagttgagtctgaagatgaaaaatctgttatatccggtatagaggatcacgtgagttcattggaataaaaaaaaaaattaatacaaaaccaattattaccggccatttgagactgaaccgctggattaatttcatcggagaagatagcatatatatatttcggctatggcgaatacggtggagttggttttatctgtttttcttgttgttgttgttgttgttttatcgtcccgttgtttcggtgaggctcaaagaagaggggaaagaaaaaattgaaggaaaaaaaaattaaaaaaaggaaaggaaaaaaaaacatgattggtttggaatttggctgtctcgttttatttgctgtatatcgcatcttgctgtttggaatcctgataccacttcactacctccgatctacttgaactcacacttttactttcacaatcaattcatttacatcaatagacgcttgatctagatcttgagcttgaatagcttgagcagcagctcggcgtccttaatctcctgcttctcctcgccaatgtactcgcccttgtgggcctcgtgctcgccctcctttcggagaggtcgtcgaagagtcttggtgagcagatccgagttgttctcaatggccttttccagattgagatcagcagagtccttcacaacagtgtactcaatgtggacatcgtcggtgacctcgagtcccagggtctttcgcagtttctggactcggttgagcacctctcgaacagtggcctcgcccttgtactcgtcgtagacgttggtgtcgagcagacagagcacgtcctggtcggaggagacctcgaacccggcaccacagtcgtcaatggttcgcgaaatggtcagatcgccctccaccagctcaatgccgtcgacagtgcacttgttggtcttgaggtagttgaaaacctcctcggaagacagctggggaagacccttcttaactcgggcaatgtccttcttgagcttcttgccgagaacgggccagtcagcctgggccttgtacaccaccttgtgggcagcctcgtcgtcggtgatgaccacctgtcgcacgttgagctcctcgacaatgtacttttcgaggtctcgcacgtgtttgaggtaggcagggtcagtgtggatgatgaccagcgacttgagaggggtcttgagaggcacgttcttcttgtctcgaatgactcggccctgttcaatgatggactggacccgcttcacagcaagctcaatgtcctcgtcaaacagctcctctcgaacctgggggtagggcaggaagtggaccgatcgagaatccgccacggaagaatcaaactcaatgtaaggcttgatcttctggtagatggtctcagacaggaagggggtgaagggagccatggctcgaaccagggtgtactcggcctcaaacagagtgttgagagccttgacggcgtcctcctctccgttgtctcccttgagacgggatcggttcagacgaatgtaccagttggtgagatcgtcaatgaggtggagcagtcgaggaaccacggcgtacagcttgtactccttcatcatggcgtgaatgtggcccaccagcgactgcagagacgcaagaatccaccggtccatgacattgtcggatttgagcgcagggttgtacttgaactcggtaccgtacagcttattgaccagagacacctggccctcccagaacttgtacgagttccaccacggcagcagaaccttggacaccacctctcgaacgccctcctcctggaacttgagggtgtcggctcgcagaaccggcgagttgatgagatacagccgcagagcgtcggctccaaacttgtcgagcacctcggtagggtcagggtagtttttgagtcgctttgacatctttttgccgtcggcagcaagaaccaggccggagacaatcacgttcttgaacggcgacacgccaaacaagtagtttccgagcaccgtgagagtgtagaaccagcctcgggtctggtcgattccctcggaaatgaagtcggcggggaagcccttctccatcacctccttggactcggggtcaaaggggtagtgtctggaggcgtagggcatggagccggactcgaaccagcagtcaaagacctcctccactcgtcgaagcacgcccttgcccatcttggaggggatggtgatgtcgtcaatgtggtgccggtggatgtcgtcgatgttcttgactccagacagctcctcgagctcggccacggatcccacgcaaaccacctcctcgtaatcgtcggagacccacagggggatgggggtaccccagtatcggtttcgggaaatgttccagtctcgggcgtttttgatccagttgccaaatcggccatccttgatgttggagggcacccagttggtcttgtcgatgttttccagcatctgagggatcatctccttgattcgcacgaaccacgaaggcacggttcggtagagcagaggagtgtccgatcgccagcagaaggggtacgaatgacgcacctggccgtcgaccaccagtcggcccatctccttgattttcttgatgatggaccggtcggcgtccttgacatagactccctcccagtcggagaccgcgggggtgaatttgccggcgtcgtcgacgggattgggggggtaccgcttgtcggaaatgatgcctgcgtcggtagcggccagataatcgtcctctccgaacgcgggagactggtggacgattccggtaccggaggagtcggtgacgtaatcggcacaaatgacctggaagcccggggtcaacttgagctttcgggcgtcctccgagtcttcaaagtccgcggcaaagtaggggaacagaggctggtatcgcttgcccttgagagaagagcccttaatgcccttttccaacacggaaaagtcggccttcttggggttcttgtacagagtggacagcaacgactccagcaaaatgtacacgtcgccggtcttgccgtccttgatcttgatgtagtcaaagttggggttcacggcaagagccaggttcgaaggaagagtccagggagtggtggtccaggccagcaacttgacctcgggctcatccaccagagggaaggcgacgaccaccgcgggatccagcacctccttgtagttctgagcagcctcaaagttggcaatgggcgtgcacagagcggtggagtagggcatgactcgatggccccggtagacagcgtccttcttgtacagctcctgaaacacccaccaaaccgactccatgaacgacgtctgcagcgtcttgtagtcgttgtcaaagtcgatccatcgacccagccgaccaatcgtcttgcgccactccccagcatatcgcatcacaatggctcgacactcctcgttgtagttggccagaccaaacttcatcacgtcttccttgcccttgatatccagcttcttgtcaatctcgtgttccacaggaagcccatgcgtgtcccagccaaaccgtcgctccacatgatgcccagtcatatgggcatatcgtggcacaatgtccttgatggtcgacgccaaaatgtggccatagtgcggagtgccagtggcaaacggaggcccatcgtagaaggtgaaatggggcttgtcagcattgagcttgagtgacgtctggaaggcatcaatctcctcccagaacttgagcaccgcttcttcctccttggagaaattcattgtgtttgtgtcggtgaatccgagtgggtgttgctagggtagatttaatgcaaaatttcacaggttagggctcgttggtttatggtaggtgactcactgtcacgtgaattggagacaagaaaatgaagaaaatgaaaacaaaacaaaactctgacatattattaccgggagggaaatcacaatttttgccccctttttatcccagaatttccaacatttttccttggctttttttttcacttttttcatcgattttttcacaaatttttcatccggtgtttttccagactttttttttaatctttttttcccccgaatttctgccggggaaaatcatgtttttcgagtggatttcttcatcatttatttatcactcattatataaacacgcaataactgcagtagtcgaagataaattaaaataataaaaaataaaaaagcccgaaatactgatattcgttgtggtggttttttttgttttttttttccaattttcggtatatcccatctttatttttcccgtttaattccatgactgaatgtgactcaaccgaaattccagttgactcttcgcctggtcacgtgactcgacattcgtctccgaaaaaatgactcatccgaaatcgcagggcttccccgttcccctgacctggtctgcacccgacgaaatcagccccggaggagatcagagattaagagtgtgtcgcagaggttatgactaaattttgggactacagtacctcaacaccaactaaccagtgtcgcagaaatggccaccatgtccgtctccagtctgtccccaattccctgtaaaatatgccattctaaacctcttaatgttcagattacggcaaactcatctccttaggttatgaatagcaagcagtgttcgtgatatacagattatgacgggtaataactatcacctgacaatctgtccgtcaagtacttgtacaagtatagcacctctggttctattttgcggatccccctttttacatgtccaaatctagccaacctttgtcatttaattatacactcaaaatcaggtcgatatgtgctttaatatatttattttaaaaagggggaaaaaacagaaataaaaagaaggaataaaagaagaattaaaagggtctacaaagtaaagccgggagacataaaaaccagatgacttttttgtttttgcgatacattttctacaaatcacatcaacctacacacgtgatttagagatattcatagtaccaaaccctaatacagatacttcaacttttaaccccagccctacagtagaaagatacccgaaacgtagcaacccaaggattttattatattcacataatacagaaagctatatatgggaggttgagattcttttttcccataatgacatgtgtttgattgtgcccgtgcccattcttcaacgacattcagtcttgaagtggaaaccccaaccccccaaaccacctaaccctgccctaaacccaacaaccctaaaccgagtaaactataatttattactagccacgccgggtaactcacgtgatctcaaattttcactttatggatacagagcaaacctcaaagataagcgattgatttgcactcaaccattcactcctttacaactgcacaaaaaaaaacaaaatgtcgacaacggtggaaaagatcaaaaacatcgaggaggagatggctcggacccagaagaacaaggcgacttcgttccatctgggtcagctgaaggccaagttggccaagttgaagcgagagctgttgacgcccacttcctctggaggtggtggcggaggcgctgggttcgatgtggctcgaactggtgttgcttcggttggatttatcgggtttccttcggttggaaagtcgactttactgtccaagttgactggtactcattcagaggcagcggcgtatgagttcaccacgctgaccactgttcccggagtgattatgtatcgtggtgccaagatccagatgctggatcttcctggaattatcgagggagccaaggatggtaagggtcgaggtcgacaggtgattgcggtggctcgaacgtgcaacctgatttttgtggtgctggatgtgaacaagccgctggagcacaaaaagatcattgagcgggagctggagggatttggtattcgaatcaataaggagcctcctaacattttgttcaagaagaaggagcggggtggaatcaacatcaccaacacggttcctctgacccatttggacaatgacgagattcgggcggtgatgggcgagtatcgaatcaattctgctgacatccatttccgatgcgatgccactgtcgacgagctcattgacattctcgaggcgcagaaccgacgctacatttcggtcatttattgtctcaacaagattgacagcatttccattgaggagttggatctgctttaccgaatccctaacgcggtgcccatttcgtcggagcatggctggaacctggacgagctgctggaggaaatgtggaagaaactcaacctcgttcgggtctacaccaagcccaagggccagcagcccgactacgagcagcccatcattctgcggaatggtcggtcgaccgtccagcatttctgtaaccagatccacaagagtctggttgaggagtttaagacggcatgtgtctacggtcagtcggtcaagcaccagccccagtatgttggtttggcccatgagttgatggacgaggatgttgtcactattctgaagagatagtctggatcctggcaaacactgagcagtcagcacaagaaaagaggaggtgaagatgaagatgagaaggatccgaccggacagaccaaaaaagagattgggatagatctcaaagagaccgggatggaccgaaacagactgggatggaccggaagagaccgggtcagagctccagacatcaggacagagctccggacactgacaaccctccatacccggtctcagcggtgtcctgatggacacacagctaacgctcaccagagtagtgaatatatcatgataggatatacatacagtactgtagagagaagggtgaatgtaggtagtagtggcaaaattctagctacaacacatctctggtgcattggttctgtgatgaatcagtcatgacgaccaccagtagacagtcatcgttggtacacagactccactgtcaatgtgttgaaatgacgacgattcaaacgtctccaacatgtgcgtacagtaccaaaagcattgaaggaaagcgttgtctcatttcaaccaagtccacacttgcgagacacctttatcactcgggagctcaggcccctcatccaggcgagacgtggttggatgagggacaagcatacactctgataaaggagtcatcaggcagccaaagggacgtttccagccaaaggggcgtttccggccattgtcgaggacccaaggtgcagaaagaccagcaatatgtccagagggaacaccagaaccatgttgagtgagtttgggtcatatctcggacgaggaattgtcgctttgattagtgagaagggcggcggggctgctgagtcatccaccgagatgacaactgaatgctttggagggatggactgtcggttgaataatcatatgtctgctcgctccatctgctgttgacttggtatcagcacaccaggactctcggtcaagagaacaggtgacacacgatccaaacctgatccagatccagcttgtttcgtctgagcatgaacgtctgcgaagaccgtccttgagcaaagcgtttgtgcccaactcgccaaaccgcgagagcaagagccagtccgagcagcaacatgccagaactacagccgccagccgacgatgccgataacacaacacgacagcgccaagataaaactgtgaactacgagagccagggtcgttgagtcagagccatgttgtcagagccattgagcgagagccattgagtcgccatgttgccagagccatcgagtcagagccaataagagcgtgtttgtgtttttttgcgacgaattggggatatttgtgtcaggatgtatgtggtatcaagttgtgtgagttgtggagatgtgagaagacttgtacaagtgcacccgtaactaaaatgtcaagtatacagtatctaaggtcactctatttacttagtgggggaaggagaactcggagacatacacacaacatcaaaattacacagctcactcatttacctggctcggttttagttgacatactagttgactgaacacgcacgtctcacatcagtaatttcttattaattaaatcgaaactgcccatcatattcatcacgtgaccacttcctccccttctccacctccccttttccacctccccttttccacctccccttttccacctcccctttttcacctcccctttttcacctcccatctctacctactgtagcctaaatctccactcaatggagaaaactccccagcacagacaattagtcagcggataatgatcgcagggatacaaaagttgtaccatttaacagcccttgatctagcagttacaacgatataatgttattgcagctgtctccttcattgtttgacgtgagtggttgtcccgtatgtacttgtatacatttattttactggtgatgaagatatttattaaagatcataagtattattggtgtgatatagttaattaacaacttacaacccacttctagggacacggcgttccgatagtagcacacacccttctggtgtgtgcttgctcgttcaccagaaaagagattctagatcagtggataaaactatctacaggatggacatctcgtctacgacccagctgattcctctcatcactatgtggtgacatctcatcattatgtgaggaattagccaggtattaccccaccggatattaccttcaacaatatttaggggaccgtgagtgtgcattagaatctaagaatcaatttgaatcaaaggtcaatatgtcatgggattcactgcaatgttccgattttctaccaggtttttttgccaattttttccctataatttttccaatttttccaatttttccaatttttccatcaattttttcataatttttttttcaatttttttccaatttttttcccaaaattttctctttcgtcaactaaagtcaagtaactgagcgaggccgactaaccagactccaaaagggacaacaaaccagaaatgagacaggtgacacaaaaggatctgtggcccatgactagacatatattacagcgacaacccctggagattggcagctgttcagctcttggggaacagtaatatatatgtgttcagccaaatgaacgtgaaagatggacgggttggacgggttggacgggttggacgggttggacggattggagatcaagagttgatggttctgagaatgacgttcccgagaatgtctcaattacttctacagcctcagactacgatatgtgctcataaaaatacatagaaatacatccgagtggtgcggcagcttttcagacagctgcttgagctcggccctccaataaataatctttctgagtcgagagaatgcagtcaacacggtcggcaagacacgccattgagagtggatgtttgtagacaagtgacaggtagatagcaacaatagttcagaggcgatgactatttgtagacatatgaccggtagacagcaaagtagttcagaggctattgctatttgtagtcatgtcaaagccgttccgattgaatatggtagttgcagagtccgatcgcagggaccgatcgcaaggactgatcgcaggggctgatcgtagggactgatcgtagtcacttgctccaatcgcaggtccacgatggaatcgcttgctcaatcgtttgctcgctatgatagtggcttgctccaatcgctcgctatgacagtcgctcgctatgacagtcgctcgctatgacaatcgctccgctcttgtcaccacttcactcgcaactcctcttactcctcctctcctctgcctgtccactgacctttctggcatgcttctccacaccattcaccccatctgaatttctcaccaccatgctagccagacaaatgtcttcataagtctgtaggttgtacttgagagactcgtccagtgccacggaaaaccgcttggactgcacgtactgaatgctgcgcaccgtatcccaccccatggagttcatcaccatggcacaggtggcggtggcactccggtcgttgccagtttcgcagaacatgagcgtgcccacccccatctgcgcggccttttcaaacagccccatcagccagtccatctgcgagatgatctggtgtccggccagaggcgagttgatgggcccgggatcgagacaatgggtttcgaaccgggccgagtcgaacgtggccttgcggaacagcgactccgcccgctccggacgcgtcaccgccaccaaaagacgcacattgttggactcaaaaaagtcggcgtttcgcagcacgctcatgggccccagccacaggcccggcagcaccatctgagcctcgtgacgcttctcatatcgccattcggtcagaatagacgggtccgacacaaagcacggaggcacaataatccgaggcagctccatcgtcggtggttccgtggttgttgtgaaagaaattaagagagtgaaagagagagagagagagagagagagagaagcgccgcgccagatgccgacatagtggaggagacacaaaacatgaaacgcgtcatagggttcgtgtgggtgtgatccggggagtaccgcaagaggaccgtcggtcacgtgatcagaaatcgtgggtagttggtgtccaaactcttcatttttggatcgagaaaacagatataaaatgtgtataattttttttaaaaaaacatataaaacattttaaaatgtacagtatatcccattctcccagcgcaaatcttaggctattttggggcacatactaattaggaaggttcccaatttggatgcagaaaaaggaatttaaggaattaaatgggaaagcgggataaggaataagaattttggaataaagaataagaattaaaggaatgaaaggatttttaggaatatagacttggtggaataatggaaaaaaggaaataattaattaaataattaaataattaaacaaataaatgaaattgaaataaagggattttttgactcatttaagtgcaattcatcccaatttggttgctagatttgaggttcgggaatatgggactgattacagcgacggcagagttacccggccggagagagaattgaacagacgtattttgagagtagtgaggatgccattgaattatgaccataaacagaagggtaccagttttgcagtatttttcttcagtatttgttagtattttttgcagtatttttatatatattttccttttttcctccattttcggggttggacccccgatcgacacctgaaacagaagaaaaagaccacatgtgccgtcacacggactccttgtatgctcaaaggtgttgtatgactgaggatagggattgaccgatttttgatgcaatttgatcttttttttaaattttttttctagtttttctaatttttccctaatttttctgatttttctgatttttctgatttttctgatttttctgtttttccctcttttcttgtttgcatttttgaatttctgctttctgaacttatctgtaggagccgctcaagcgtgtcaaaaagtctacagaatcatgtcaattttgacgatatcaaaaaacagagacttgccttgagatcctactggcaggagattcaccagtgcccccatataacccgccggaactccacaacatacctaaatcaaccatgctccatcttctcatctgggccttcaaatcttatcacagggtttagtcacggcaaaaaaggatgcagcacaggagtgagaaaatgtgacccgaacggttgtataaaataggccgaaaattcgcaggaggtttttatacggccagcaacttgataccgggcttcagcggctccaataggtggtttattgctgtttttagaacgatatccattcccatagtttgcgccaccatcgaggttaactgctagggctgttcgggtgctgctggtacagagaaatactcggtgaaaaggacccaactgacattgtcgatagatacacacgcaatctcccctcctacgaggcttcccactagcaccgcgtgtttgtatgtcctagtctgaggggaagcgagtcccgactaatggcaaggcgactaaaaacggtgattagtcgatgatgactagctggagattagtccatagtgactagtccatgatacggttgtgtgagacatgtcaggactcggacggtcgtttgacaccggctctttgtatcttctcaccgactctttgtgtcttctcacacgacacctactcgtactgtactcagcactacgtatttggagatgttctgttatcgtcgtgtcctctcctcctcctgtaacgttacagccactggggtggcgaatgttaatactataggtcgttgaagcggggcaattgtcacatggagttgtgtctgtggtctttcccacccattttcacccatttttcatcatcttttgcaacttttcatcaccttttgcaacttttcatcactctgcaacttttcatcaccctttgcaacttggtccttttttaaaataacattttttaaccggcattttgctcccatgtacgaatacaccatttagactctcaataattaactacaaataaattaggacagagaaaaatgacatggcttcagagtagtctcagagaaggatttcaacgaaaatcatttgacaaaaatgaccaaattgacccgaattgacccgaattgaccccagattgcctcctcgcgccctcctttgccccatcaccgtttttggaccacctctgttcctcttccctcctccattgacaaatttcaaaataagcttctggacactttcatattaagctttgcccatttaggctcaacacttcacctcgcccccgccaaaaacaaaaaaaaaagacctcccacaaatcgccaaaaacaaatagattgacgcaaaaatcacacgctgcggtagtcatgtgaccccaaccatcccgtttccaaaacgagcggcgcgattcgggccattttcgcccctttttttacccgaccctttctgctcagacttagacccaccatgatcttcagacacacggtgggtgcaatcatctctcgctgattttctgtcttttttgtctttttttgtccttctttgtcttatggcgatttttcagggcccaggctaatcccaccaatcttaaccaatattctctgcctttggtcatgtccacacagtgtccgaattgtcctactcgtagtcctaccgatcgtttattccaccaagaaattagcggttttttgcatactattttttcttgctacttttttattactattttttagctattttttagctatttgtttttattttgctatttttttttcagactttgcgtgcaattagctttgggtaactgacaaaggaggtggaaaatttttgtcggtgacgtgcagccagatgggagttaccctaccctggtgccgctggcttatgttaaaattttgcaccttacagtctcctttttttctcttctctttttctcttcatccttcagtggaactaaaagaacttcaaaatgggtgagtacgagcggcagcgggaagaagagggcagcgatgacaagcgagtggtcgcgacgacgaccggcaatggcccgattgatcattgatctggttttgtgtcggacacaaggtgccggagaaaaggtgtcgaagacaaggtgaatcgacacagtcccgacacgacagagatacttgtagacaagccgacaacagagcaacgagcaacaagatggcaatcgattcagcagtgcatgaggcgacgaaaatctgttgccgttgtatgtcagttggataattggttctaccacgttgtcatggttgtgatttgtcacgagcacgtgtcctttggcacacacgccacctcacctacatcaaacacactcgaacataaaaactaacccagttaacttcactgttgagcaaatgcgagagctgatggacaaggttagcaatgtgcgaaacatgtccgtcattgcccacgtcgaccacggaaagtccaccctgaccgactctctggtccagaaggccggtatcatttccgccgccaaggctggtgaggctcgattcactgacacccgaaaggatgagcaggagcgaggtatcaccattaagtctaccgccatttctctttacgcccagatggacgatgaggatgtcaaggagatcaagcagaagaccgttggtaacgagttcctggtcaacctgattgactcccccggtcacgttgacttctcttccgaggtcaccgccgccctccgagtcaccgatggtgcccttgtcgttgtcgactgtatcgagggtgtctgtgtccagaccgagactgtcctgcgacaggcccttggtgagcgaatcaagcccgtttgcgtcatcaacaaggttgaccgagctctgctcgagctgcagatcaccaaggaggatctctacacctctttccagcgaaccgtcgagtccgttaacgtcatcattgccacctacgttgacaaggctctcggtgactgccaggtctaccccgagaggggtaccgttgcctttgcctccggtctccacggatgggctttcactgtccgacagtttgccgtccgatacgccaagaagtttggtgttgaccgagaaaagatgatgcagcgactgtggggtgactcttacttcaaccccaagaccaagaagtggaccaacaaggacaccgacgctgacggaaagcctcttgaccgagctttcaacatgttcgtcctcgaccccatcttccgaatcttctctgccatcatgaacttcaagaaggacgagatccccgccctcctcgagaagcttgagatcaacctcaagaccgacgagaaggagctcgagggtaaggctctcctcaaggtcgttatgcgaaagttcctgcccgccgctgacgctctccttgagatgattgtcatccacctcccctcccccatcactgctcagaactaccgagctgacaccctctacgagggccccatcgacgatcctttcggacagggtatcaagaactgtgaccccaacgccgacctcatgctgtacgtctccaagatggtccccacctccgataagggtcgattctacgctttcggtcgtgtcttcgctggtactgtcaagtccggccagaaggtccgaatccagggtcccgactacatccccggccagaagaaggatcttttcgttaaggctatccagcgatgtgttcttatgatgggacgattcgtcgagcccattgaggatgtccccgccggtaacattgtcggtctggtcggtgttgaccagttcctgctcaagtccggaaccctcaccaccaacgaggctgcccacaaccttaaggttatgaagttctccgtctcccccgtcgtgcaggtcgccgtcgaggtcaagaacgccaacgatctgcccaagctcgttgagggtcttaagcgactctccaagtccgacccttgtgtcctgacttacatctccgagtccggtgagcacattgtcgcctgcactggtgagctccatctcgagatttgtctgctcgatctcgagcaggaccacgccggtgtccctcttaagaagtctcctcccgttgtttcttaccgagagaccgtctccgccgagtcttccatgaccgccctctccaagtcccccaacaagcataaccgactttacgttgttgctgtccctcttgacgaggaggtctctctggccattgagtccggcaagatctctccccgagacgatttcaaggctcgagcccgtgtccttgctgacgactacggttgggatgtcaccgaggcccgaaagatctggtgcttcggtcccgacggtaccggtgccaacgttgttgttgacaccaccaaggccgtccagtaccttgctgagatcaaggactccgttgttgccggtttcaactgggctaccaaggagggtcctatcttcaacgagaacatgcgatccgtccgagtcaacatcatggatgtcaccctgcacgccgatgctatccatcgaggtaccggtcagatcatgcctaccatgcgatccgtcacttacgccgccatgctgcttgccgagccccgaatccaggagcccgtcttccttgtcgagatccagtgtcccgagaacgccgtcggtggtatctactccgtccttaacaagaagcgaggacaggttgtctctgaggagcagcgacccggtacccccctgttcaccatcaaggcttacctgcctgttaacgagtctttcggtttcactggtgagctccgacaggctaccggtggccaggccttcccccagatggttttcgaccattgggaggctatgagcggctctcctctcgacccctcctccaagcccggagctattgtctgcgagacccgaaagcgacgaggtatgaaggagaacgttcccggttacgaggagtactacgacaagctctaagcatgttggtatgtttgcgagtctagaaaataattgtaaaaaatcacttttgaagagatatcagattgtagtgttgaaattcagtagaataagtaaatttgtcgagccagagttggattgacaattccattccttttgcaggcgtggttcgcaatgcgtcactcagcctgggatgaatcatacctcaactgatatcataagtgcgagatgtttttgatttcctcttctctggttgcaccatatgacttcattcgagatggactgtcgaacctacccagtgcattatggcctgtctagtgtgtgtctaatgtatgccgtgatgagaatgtaagcagtaaattagagaagttagccagtttgtggatgtttgggggtacgttgcgtgttacctctaagatgaagtagtagtagctccctcttgttccttgttttgctccttatgctccttgtttctgttcaacttgcgcttcagctcctcgttctccacacgaagaatgccgagctcgatctcgtgctgaacgcttcgtccagaccccagcattttccccagacgtttgttctcgtccaccagagactgtagtttggagtagactctgaaggcagcggcctcttcgtgtccgtcacgggccatgagagactcaatggtagtgttgaggcggctaatctcgtcttccttggccttgaccagctcgcccatgtctctgaacaccttctccaccgaaggctccactctatggacggtggagacgctttgtttggccagcaactgggtcagacgagccacctccttctgtagtgtctcaatctccagcgattgtttccacgacacgctggctgactgcagatgaggggggtgaacaggcgtggtggaaaactgggtttgtgtctgtcctccgtatgaaaacgattgcagagagatctccttggaccggtcgaagccaatgctattgccgctgcttccgtagggtgcagaatagtagcccgtggtgttgaacccacgtgacgcccctcgcgagtagcttcccgagccatggctgttgtaggtcatttcctgatcgtaatctctcgaagagcccggtgcacccttcccgtggctggcaggtttgccgtaattgccggccatcacagacagaatagagtcttcttccgtcacctgcgatcgttcacttccgatggttccgtacatgactcgcgcgtgtggtgtaagtggttggagaggacgggaaggacctcttaaataaagagtgcaccatttacttggttacaaatgccctgtaacagcgtcagctgagagagaaatgaggctgcagggaccgaagcgaatgtggggtggggtgcataaataaattaaaaaaaaagagaaagtaaaagagaaattaaaaaaacggtaaaaagatggaatatacataaaacggaaactaaataaatccattggattgaattgaattgacaatattttttttttttttttgaattattctgagcaaaaatggggggtatatggtacagtacatgtacaatacacataagatgcttttatatatatatatatatatatatatatatttttggtttttttatatatatttttggtgtatttatttattttttatttttggtttttaatttattattattttttgagtgcgatatgatttataagcctttactttatatcatttttattttaatgaataaagaaatacgacccaaaactaacctcacagaaaagagactgaattaacccctacaattgggcaacaagtatgtacatagaacgaccaatatctccatgacttgattataccattgtaaagtgatcatatatccgagatagcatttccgaacaacttacaatttacaatttacatagacatgaagtcctcttgtttgataatcaggatgaatcaagtcctcaagaaaggatggctatgggactactgtatgtgtcaaagtcctcatccgtctaccacttgtctaaatgactacatgattcctttagtcggcttggctattggtttggtattacgtgctcctttacaatccacaaatttgtcatcatcacgtaatgccaagaggggctgtggaacacgattgtatagcctgcgatgattcgagtagtttgagacaaatatttgtgggatttcgagcatatataagatggttatatcaatatttatatcaactattaggggccctgatacatcgcgatgagtgtccactttttagtaggggggattacaaagtctacaactcgaggtgtagaaactccaccaagacagggacttcaccattatatttctactgttctcagaatcattttgatactcatattgacctagataatattacaattcattaagttaagagttatattagtaaggatggttagagaagaacgacacatccggcggcaatgacaactccagcggcgagcttggcgttgaaagaggcgttgatgagttcgggagccatgttggaggctccggtggcggacgaagagccggcagctccggtagaggccgtcacgttgggggaggtgacgttggaagagccggaggcaacggcggatccggaggcggcagcagagccggaggaagtagaagcggcagaagtagcagcagttgagccagaggcggcagcggagccagaggcggcagcggagccagaggcggcagaggtggcgtcagcggaggcagaagttgcagaagagtcggctgaggcagaagcaccggaggaagaagcagaagcagaagccgaagccgaagcatcagcagaagagtcggcggtagcagaggcatcagcagtagcagaagcatcagccgagccggaagcaacagcagaacccgaggcaacagcagaacccgaagcatcagcagaacccgaaacagctcctccggggagaactccaagctgctgaccaagtccaagaacctgggcggtggcggcgtcccactcgctagaaaactcgggggtcagagagggcagatcgggagtgacaatggcccagacgttagccaggtttccctgaatgttctgcagggcttgggggatgtcgacggcgctcagagccaggaatccggagctgactcgagggaagtcggtgcctgcctggaaggcggacagggtggcggaagcctcggacaagagcgaggggaagttgttggtgttgaggccgccggcaacggcaggaagagcgtcgtcaaacagctgggagatgccggggttgttggtgacaatgtccatgacggcccagacggaggacgaggcgtcctggtcggactggctgtcatcagtctttgctgccagaataccgtcggcgatattggtggcaatagaagccacaatggggttctgggcgtgggcgccagcaatcagagctgcgagaatcagagattgagcagagaccatttttttgcacttgattgtgaattgagaccagagtacggggtacttgttcgagagtcagcaaagagcggcccacccatatttatatacaacaactccacttagtccccgctcccccccttggtcaatggcagtgttgtttggccaaggtacgctaacgtctctggctacttctttgtcaaccacgactcagaatttataataatccaggtccactaaccagttttgacagcttccccgcgagtcgggggtcaagaagtggcttgtgcctgtctttaatgaagggggcggggctaccactgtagcgtcgaagacaagcgactggagaagtccaactgatgagctgagaggacaaaagagtccactgaccggagtccccaaaactgagaatcagactgagaattgctttagaccaacgagaatcaaagactgagagttgcttcagaccaaacactgctgatgaggctacaccatcacgggctactgcgggctccccttcagccgcacatggatctactggtaccagtattgcacggtacttggcgagatccgagttggaattgcatcgatggcacccaaatgctatggaaaaagtccccaaacattcgttcataggcgcaaaacctcgcccatagacgcaaaacctcgtccatagacgcaataccccttcatagacctcttatgataactgagccagggatactatacaatactgtacattatccgttagtgtatcttgtcagagtaggtggtgataaaggggcagccgcaaccctcgtactacacctctttggtgactctttggtgacaatcgaccgaggctggctcttggcaacggaccaaacccgtgacagtctagcagcctactatttgccacagtcaccacatctccacgcaacctcgccagccagctctcctctcatgcgcctccccacacgtttgccaatctcgcacgtcactgcgagcctagacaagcacctgacagcacgctaaaaggaccgctaaaagtacagcgtgtcccaagaaggcaagcccgggcagacacaaggctgttggaggccatcgagtggttgctgtcatgtgcgatctgccacgtaaaacaaccatccacgttccgatcttgtccgacaggtgtctgaaaagtcgactgtcgcttgtagtgttgtgtagttgagaactgtgggcagaaaactaaagctatacggaataattatcagaaatctgcgaatcggtgaatctgcgaatctgcgaagtctgctccacattccagttggaaaggaggactgaaaatgatttacaagtgaaaagttggatcgaaaatgatttacaagcgaaaagttggaatgaaaatgaataaccagtgtaaaaattggtccccaaatatcgctaggtcgaataggtcgaaaggtcgccaaaaaaaaaaggaaaaaatctgaaaaatgacaattaatttagacaattaaacaaaatgcactcctcaccactcctcattcaacgcaatgtggaaaacacagacaaattcgtcccagacttacagtataagtatgtacagaattgtgtacacactcgtactttactgaatctggaagtatatacagtacatactacttgtagtatatatactataaattctgttgaattataacccaaacagacaccccgagcctcgtaaaacacgcaaaaatgatcgaatttcttatattttttgaaaccccatttatatacaccatacacactctcagtgaaattatcacgtcaaaaaatcaacccaatgataacttcaacacctggcataatcaaagagccccgaaccttaaatcctaataattggagttttttaatttttatttatattcatatttatattttcataattaaaatctgtaagactacaatatgtatgtactacaccaaacacactgtgtcaactttttaaatccattcattaatcatacataactgtagctcctccaccacgactttttaccgtcttggggcctcatcctgctgatcataagaaggatcaacggcgcccatgagcaacttgaccagccacagagtgggggtcagatcaactcccagacgagccatctcatcctgctcagtttcgtagttggaggtacaatcgaccatacctccgacatgaggatcgttgtccagctggcccaggaaatctcgtgccttgagatcgtttccaacctgggcaaattggaaagccacggctccgggaccgtatcgggtctgagtcagagcctgcttggttcgcttgatcacgtcaaagatcttaccgtgaggctctccagcgggggttccatcggtgatggtgatgaccagaacgggcttcttgagaccgccctgtcgagcgggacccacaaccaggggctggatgacgttggcgtccagagaagagcccagaggagtcagaccggagaacttggcctgagcgacaagagcctgggcagcctgctcgctggcaattccattacccttgagcgagtggttgttgaggaatcgcacctcgataccgtctcggtcaaacaacgaggcggcgtaggcacatcggcccagaatgagcttgagatcgtcgattcgctcaccgttctcctcaaaggccatggaaccggagtcgtccacaaagaggacaatgtcatatagagccagtcgcaccagatcgacagcaatctccatgggcatgttccactggccggcaacttgctggatttgggtgctgatggagcctgcaatctgctggagagcctggggagggtagaaggcctcgagatggttctcctgaaccgccttctgcagcatctgcaggtactggccctggttggctcctcctccctgggtggggggagcgccgtactgtccttgctgctggggaggctgtccgtactggccctgctgctggggaggctgtccatactggccctgctgctggggaggctgtccgtactggccctgctgctgggggggctgtccatactgggactggccaggaggagcgccagcgggaggtcggttgtactggctggctccgtatcctgcagcggctcctgcggcggctcctgcggcggctcctgcagctccgtagcctccatgctggccggcgccctgctgactataagcggggggttggcccggtctagggggttgttggggagctccatattggccctgctgctggggaggggctccgtactggccaccctgagggggctggccatattggccctgctgttgagggggctggccatactgaccttgctgttggggaggttgtccgtattgtccctgctgagggggaggagctccatactggccctgttgctgaccaggaaccgggtagggcgcttgtccgggagctccaccggccgatccgccaggagcacggggcggaatgcctccgggagcccctccgggggctcctccgggaacgcctccgggtggggcgcctccctggttggcctgagcggctgctagtttgcttgcgagacccatccttgtgtttgtgtgtcttttcttttctgcacagcggttgtttctctgtgtggcttcttttgttggtgtcaattgaattacttgcaattgagcaattggtggtggtgaagaggaagaagaaagatagttcgacgacgtggtttatctgtgtgcttggccgtcatgtgttatatctggtggcacaaacaccccagccgctaaagttagagttgcttccccggagttgtctgcacgaggcccaaaaaaagataaaaaaagataaaaaaaaagagggcagtgctgggcgaagcaatgatgggcggagtcgctccaaccaggtcatgtgaccaaacaggtaggaaaaaaacatacaaaaaatacctcgtcggactgacgaagagggcgattgatgacatctcagagcaaaaaaatataaaaaatatcacctcatccttctgccaccctaattaacttaactttgcggtgttactgacgaaatgactgacagtcgaggaacgagacggaacaacctcagctaaattataaaaataaaaataaaaataaaactgtggataattaaaaatggtaaaaatagtgaaaatagtggatcaataatggctcaatgcccatgactggaatagcatggtcgaatgaaaggaatttatcataaccataagacaacgctgaaaaacaggtacaaatgacccccaaataatacctccatgtgcacctccgacctaccttctatgcatctccatgcactttgacgtcagagaaataatgcaatataatacaggtttgtactcataccccaattgcagtaggcagacatggactgtcacgtgatctgggctcaaaaagagtcttcttttcggagtaaaaatgagtctccaatgtcggagtacaatgtcgccattgcgctgttggtgaggtaattgattcctggcggggtggtgttttctgttaaaataaaaaaaggcacctgaattatgtgcattatagggagctgagctacaagacgcaccaaaaacgcattctaaaaacgtgatgtggatccacctactactgcgcacgatcagatgatgactctgttttgcccggagttaactggtggcgacttgtgggcttgagtcaccggcaaataatgttctaaccgtcgtgccggactgccgccatgcacggttattttgaagcggcgaaaaataaatgtaaaaataaaaagatcaaaatatatataaattaaaaatcaaaaaccacttgcaagcggaaaaatggagtgagagggaggcattcatatgtttctagattcatgagaaatcgaccatggccaatgtatcgtaataaacccgatttccgcttatatccgatccggagtgtgtgaataaattataaattttggaaaatatgaaaatgcgaaaatacgaaattatctccataatgggaaacttctgaaccatctaagggagcattcataggtacttgtattttttgtaaaaattgaataaatttatatttatgaactttaaacgtcaggttccgattacaaaatatcgaataaattctggaaaagattcagcagaaaatataaaggtgtttattcacgtacaactaaaagtagctacaagtacttgtacctctttcttacactcactacttgtagtaattcaatcaattttcattcatttttttgattaccataacattaaaacctgccaactccaataaacaaaccatcataaataccatgcacaatgtcatcctactagtagacaccttttcagcgtcttccacttgaattcttccttagaatcttgcccagacaggagcacacttgagtctcgaggctgtgaggaagaggaacgaaaaaatggtcattcctccggtgaaacaaatgagaccagtccagctggcggttccgtacacagctccagcaacaggaggaccgatcagagagcccaacgaggcaaccatgtaacaggtgccgtatcgagttccaaaagactttgtgtctgagatctgtccgatacaaacgggggtcagggagatgaaagagcccgaagtgaagccccacagaacggcaaacacaatgtagacggcaaacttgttgctggtgggcagccagactgcgaagatgaagagggcggtggaagagatggacgccaacatggtgttgaaacggccccatttatctcctgtccagccggtcactagacgtccagcagcggatccggcgtttgaaatggcaaaaatccaccatccaaacgagtcttcccccttgcctccaatctcctgttcgataccatactttccgaggtaggtgaggggcacaaacagagacagctccatggcaaagacggaaatgaccagcagagtgaaccgcatgtccttgaacgcggtaagatcgacagcggcgggttttttggcggttcgaactgaaggagtgactccagggttggctgcaagctcgagtttctcctcaatatcgacaatctcaggtcctcgagagtcgcacagaatgatggcaacaatgagaagacccaaatagacgaatcccagaattcgcatggcccaggggaacccgtaggccgtgatgcagactttcatgacaatggggaaaaccactcctcctaccgctcctccacagatggcgatgcccgaggccaggcctcgtttttcgttaaagtaatgtgagacgcaactgggcccaacaacaatcaaaacggagcatccgataccggtgcagataccgaacgacagcatgaactgccagtagtttgtggactctgctgttgtgaaggttcccagcacaatgagacaggctccaaagatgttgagcagccgggagccataccggtcgaagagagggccgatctggacacccaggaagaaggacagaaacgcgtagatgccgaaaatccagccaattttctgctcgctgtcgttcttgaggtacgtttcggaaatgtacgagttgacggaaccaatggtgttcatgatccccagagacaccacaaggccacagaaggacccaaacaccaccgtccaggcctttcggccgccctccgggtacagaggcgggatatcagaaaaagtgtctgacgatgagtgtgttgacaacatgtcgtggttgtcaacaatgtgggttgggggtggttcgtccccgtggcggtggttgccttcattgtcggagctgtgcctgtgggtgtgttctgagctgtgggacgaggtgggttcgaccagatccgaaagctggtgtttttcgtccgtttccttgtcttggacttctcttcctgtctccagatcaaggggtgcgcttggggtggttcgggtgctctctcgggtctccgatcggtaaatgactccggcgtcctccagctcctgggccactaatcccacggggtcgcgttggtacgagtattccatgctgtttagacaaaggcgaaaagacgttggcaccgatgacgagggctctggttcttataactgctgcttttcgtgagactcatgactttttgtgcacattggagcgagcttggactaggcgtcgggaaaccacccccgaaatgcaggtcgagtttaaaaattgaccatgattattgaattaaaaaagtgatagagggcggccaaagggacgccaaaagacgggaaaattggggattttatgagataaatctgactattggagtccataaaacaatactatttgttttttttgcttgtgcccccccaaaattgtcttcaaaatgccgtctttcagccctccccatttttaccctcgtatctcaatccatttcagagtttaatgctttccgtcccccatcaataatcagtcataaacgtcctcataaggacatggcgagcgagctggtctagaaagcgatacggactagtcatcatttgcggctgaattttaagacggtgaaaaagtcccgtctaaaaaatcctgtctaaacactttgtcgcttctcccatttagccgcctgctgcccaccctacgaggatgacgacgaacgtttgacgtgactgtttactttgtggcttacttagcaaggaaaaaacgtgccaataacgctactaattcgatacaagcgacaaaaacggcctcgaacgaccctggactgtgtaagtagcatggtagatgcagatacggaaggcggctaattcgaaaccgggtaaaatgtcacgacgagacagattgggcttgtaggcgagcgcaagtatgactgtctggtattgtccagaatgggttgtattgtccagaatggtttgtattgtccagaatggttcgtattgtccagtattgtctagtattttgtccagtatttttccaattttccaattttttaatttttccaattttccaattttttaatttttccaattttccaattttttaatttttccaatttttccaatttttccaatttatccaatttatccaatttttcgtaattcaatttaattatcgccaaaattcaataaaatcagaataaaacaattctactccgtaaatgactttgtatcaaagaaatcacacgcgactacaataaaacacctcgccctgtcgctcctcctcgcggtagtcgctcttcgtatccttctcgggagacctgtagcaacagaaacagcatttgggagcgagtgtgggggaacaaaaaaaaaaaaagaatattcggaaatgcggggaaattctgagaaatcgggaacttcagggaaaaatcgaggaaaatcagggaaaaatcaggggaaaatcagggaaaaatcaaggaaaatcagggaaaaatcgaggaaaatcagggaaattgcaaacttcagagaaatcggggaaaatcagggattgtcacatctaaaatcatctcctcactcttgactattgactcttggctcaaccaaaacccaccgcaaacaattcctcagctgatcataagctgatatgagaagtaaatatagccgctgctgcagtgagcaacaccacattctaagcaactgtacaagtacttgtgccgcaaacaccgacagaagaaaaaataaacctcaattaatcagcccaatttgacagcagaaccgttctaagccgcgtcataagcccaatcatatcatttctctttttcccgcccaattcaccgctccatattcgacctgcatgcgttatcacgttgagtttgggcggatttggcctgcgttagtataccatagagacactatgacaagttgaaaacgcgacaagtacgagaaatacgagaaattcaagtgggaattgcaattatatcacgtgacctccaccctccccacacgcacgcggtccaccgccagacagttttgcctgtgctgtcaagacacatcgcacatgcagcaaactcagatagacgacagactcggtgatacttccagcacatcaccagtgacaccaccacagttacacaaagacacactaaagacacacgcgttctctgtctaatgttccgaatcgcccgaacacgtcttatgcccggtctcctgggtctcacaaccgccacggtgggtctcagtatggcctcgtctctgcacatgccacgcatctacgccgacggtcttcaacagcatccagtgtctcagcagcaggtgatcaacaacgtgaaccgtgacgtggagcgggtttcgcagcaggtggagcaggtgggcaagaaagtcgactaccagcagctcaccatcggctcgtttgtggggctcatcagtggagttgtgattggcaagttttccaagattctcgtgtgggttctgggaggcgcgggtctgctgatccagtttctcaagagccggggaattgtcgagagcaaccctctgacctcaaagtcgttccgagagggcgtctaccacaagctcaagggcgttgccatggttctgggtctggacgagaccgactaccaagagctcatcaaagacaagccctcgttcaatgtcgccttcttcctctctttccttgttgccgcctggaatatttagacaattgtccatgtagagaatacatctcatgtattggtaggtggcgatttttacttagacgggtgaaatgtaggtggattttagtcggggaattacttgacattaaggagtttcttaattaaacattcaacaatggtagatgggtataacaagagccaactaaacactccactttcggtaccacacttcactttcagtactgcaccagaaatgtccggggcgtctcagacttggaccgcaagatataaaccgtcaatcaatcctcaggggagcatcttaaagccctttcaacccccccaatagacccgaatatctctttacaatggcccatcaaatgcacgaggaactcaaattatcccaaagttcaccactcttagatcgtctgaagtcagcacagctgttactccattgacctccagcaatgaccaaggcagcacgcgtttcgcccatcaagaagcttggccagtccaccgcggcctgttccaccgttgtgagtatgagtggtgaccggaaggagtagggatctagaggtgaccgggagcgagaggccctaggagcaagaggcgaccaatagaacgggtcagacaagcagtgttcacgtacgtgatccgaggtattctccaaccactctaacacaggcgtcggcatacggcaaatgcatcttggaaaactatcagaccgtgtccaaggacatgtgccagcaagagtttgccaagttcaaggactgtgtccagaagcagatgggcaggaagtggtgatctcgacggagtagaccacagccccgtttcccccatgtatatagattaattttattgaccaacattgaagttgacctgaggacagtccaactcatgctctgtgaatggcgatggacctgctgagaagaagagagaatgtgatttgagaggcgaaagtatctggcatctttgatactggagcggagccgtagatagcccgagacaaccagttgatcgccgtgactacaagtacagtttactcattagtgagctcgaaaacatgatccaatggtccgataagtacaacgctcagttctgttgctcagtcgaataatcacatgttggatacatttcccgcttctcatttcgtttcgttttattttataccgcatcctaatcatattcccactcgcaaccaagcgtaggatcaaatcaaatcaggaaagaatgatatttttaataaaccaaaaataaagcattaggaacagcacaaccttcagaatcctcaaaatctcaatattcatttttttttctaatgatattttttttttttgtgtatagggaaataaatttcagctactggcctaaaacgatgttatacccgtaaatctgattcggattcggattcgactgttcagaagaacgcatgacattcgtgctcgctcgttcacgtatgctttttttttacatttcagctattttcttgcattttaataattcattacagattacgtaatcggacgtcacagtgacaactccaggttttcggttttcatgttagggatcagcggctaagaaatagccgcctgattagtctctcgtgaaccgctagcggagactacgacgaggggccaccacgtgggccctcagtgggattacgctatcattaatatcgatatgccaagcctgctatcacggacaaagggctgcgccgcaaccctggataacatataaacccctgtattccatgtattctaatacacctttcttgagagtgacggcagtgaccataccttcggtatggccaccccggctgagtcatcagtcggcttagtcacggggcctgggttctaacatttcaaatgtaatcttggcccgatggtttagtggtataattctcgcttagggtgtcctaggcaatttgcgagaggtcccgggttcaattcccggttgggcccattatttttacaagtatttttgcggcgcattgccaatcaatttttgcttagtaagaaacctaggattttcagtcgagtaaaaccaagattgaagggtatatacacaattaatggtattatcagagcgattagagaagacaggcaacgtccttttttaggagatttgactcgtgatggcgtatgtatgtttctagagacttttgagagtagttcgaatcacaaatccatgaatataccctgtagaactacaaaacttggccagtaataaatagtggagtaaataaaagtcccaaactgttcagatttatcaccagatttctccttccagacttatagtaccttcaatgataaggttcgcaatttgtcaattaatctggtagaaccgttttacaagtatgtcaaaaaccgacctgataatctgattaaaatgacagattcaagtggtacccgactcatctaagccgggcgaacattacagagccaatattccctactttgaaaagtttgggtctgaacggcacgtgactggagaggttctgacagacccccaagtggaccatggtgtaacaaatttctcactagactcgatttaaattaccagtgtttagtgagatgttcttaaagaaaggaacttgtaaatatatgcaaaaaaaaatgcaaaaaaatgcaaaaaatgcaaaaaaatgcaaaaaaacaaaaaaaaaaaaaaaaacagtaggtatcttctacaatctccattcccatgaaatgctgaatttttagtggtcacatttcgtctcaccgctcattcctaatagtattgtaacttgtatcatactcgtacactccgtcaactgcgtagccgcatgttgtctcagcttcgtgtaggatcgacacattctaaagtagaatgtgaagatcacgcatagaatgaatgacggtttatgaatgctaacatagcggctatggccacatgggcatgcggggtagttggtggatgagctacgagacgagaaactcggcacaagtgttggctgcgagtattcaacctgcaatttcagttggggccttcgcagtgccctcttggtatgctatgatgattgggttgacatcagtacatactggtatcagtggaaataatttcggaggttgtgtggacgaagcaggagctgaaacggggctgtacggcatcgactgagagccgcggagtcgtcgtaagagcctcgatccaaatctccgagcctcttgttattggccatgtgacttgtacgctagacgagtgggcattggagactccgctgtagagtatactatggtaggtgtgtaaacaatgccagagtatggaaatgtactgtgcagtacaagtacaaataatacacagcaagcaagaccttacataagcgacaccgctcagtgcgctcttccagccctgtccctgttcccattggcacactcggccaaaaaatatcacaggtgcattctcagacgcaagtccggaatgtttcttttgcaaattggtccttttcggctccactacaattttttaggttgggaggcgggatggacggggggggatcaagaggcggattcttggggtcaacccgatggattttggcggttgtaaagacgaatccgggacaagacggccaccagaatccatataaaccaaccgtcaaagctgtgtcagaccaacaaccagccgaaatcaactcccaaactcccacagccccgacctaatgggaacactcgtcaccagtgacatacataagaatgtaactttgagggaggtgcgtgtcgacgtgtagaccgcgtagaaacgtgtcaatgaccttcctagagccggaaacggcccaaaaaaggagcaatgtggccgaaacacgcccaataacgtgaccagacataccaaccctctcccttgcggacgacttccccttcctggcgccgtgtctcaaacggggttgctgcgcaacgtgtgtgtagacccaaaccttgttgtatctaaacatgcatgcacggtcccatagccaaaagtgctaataagttggaccgttatacagctctctacaaccaaacatacacacacacacacacctgctacagcatacgcccagctaaaccggcttatatactgctcacaaataaatgtcgcgggatcgaatgtttggctctcgtctgacatacggccggcgcaacaagtcgtcgtttctgcgagaaaaacaggaggagcaaatgctgtgggaccagcaggaaacgtcaacgtcttccaacaaccccaaccgtcactcgggcgtgctcaaggagtcgtcgcactccaagaacaactccgtctcgtcgctggctgcgctcaaacgacgatcttccagcaacaccgcatccctcgtctccagggacaacaacaacaaggagaacgagaacattgctctgcctcgaaaactcgacaatgctccccgctcccggccgctgtcgatggtctcgacctcgtctgtatcatccacaggctcgtcgactcgaacagtcttgctcgatagagtgtccaaggccttctcttctctgtcttccgaccatggatcaagacggacttcggtggtccaacagcctcctcacacccccaagcggcagatgaaccctgaaagtcgatggtccatgaccacgggcacgaacacacccagcacacacacaggtagcacccctgcgggccgcacgtcatctctacgacgctcctttgtcgaaaacaatctcaactcgttgcttgcagatgaagatctggacctgtccttgcatcaatactcttttgacaacaaagatacagcttctaattcaggagacgtttctatggagtcagctcacagtatcactctccagaatgacgaccacgaccacgaccacgatgtcagcatgaacagtcaccccagcaacgcctctctggtgtccatcgtctccaaaaccggtcacggacgaaaagagtccgctaccttctacatgctcgaaccccctcaacaatcaaactcttctctgcattcatactcacaccactctcagtataacaactcacaacattcgacaccctacagacagtccctcgctccagctcagtcgctgcgacaaaagatttcgctcatgtcattggagaaacatgagcctctgcgacgaaaacacatttcaaaagaaagcatttccacccctcgggagctgtccaaggacgagcagcgaaagggatccacttcatcccactcgtccttcttctccatcaagtctttccgatcgcaacacaatcaaaactatgaagatagaaccccctcgcggtcgtctactgcctcttctctggccagcatgtcatccaaccattctgaaatgtccattaaacggtccttcagtgacgtgagaaagtccatcttgtccctccgaggctccagctcgtccagcaactccgactccagaggaaacagaagatccttcctgggaaaacggaccaacgaaccggctatggcacacgtcaaagcccagatctcgctgcccacaccagacaatctgtcacgtgacaagctgcgaaacaaactgaaggcgtcgacgtcactgctgtcgctgacccggtcggaaacagacacatctcaagtcgtggccatgccatttgaagacctgcggaccacccagctgtccactctgctcaacttgtgcgactgcggagaggtcgtcgatttcaccttcttcctggactcaattctgtctgaccacaggcagggagctctggtgaagctcgccgaggcgtcttactcggaagtcttcgcgcgaggctcgtccgtgttcaaaatcatcccctttggaaacgacgagcaggaacagtcacctgtcaaggacattatccaggaactgaccatcgcaaagaccgtgcagtcgttggagggctttgtcaaggtcctaggggccactgtgtgccgaggcaagtacccggaccacctcattggtctgtgggacgactacgccaacttcaagggctcagagagccaccgacccgacttttactcggacaaccagctcttctgtatcgttgagctcgccaactcgggtacagatctcgagcattttgaacttgagagctggatggaagccgagtacgttttctggcgcgtcgtgagttccattgccgaggctgagtccaaattccagtttgagcaccgggacctgcactggggcaacattgtcattcagcgaaccgcgcgtcctgatatcgaagagaagctcgccaacatgtctctggatgacctggacaatgctgtgtttgacgacgaagacgactttgtagctccaaacctcaaggtgactctcatcgactacaccctgtcgcgagctcgagttcccgctcgatacggcattgacgacggagccgtgacgacagtcttcactggtctggaccatcccgactttttccgaggccggggcgactatcagtttgacatctaccgtttcatgcgggtgctcatcaactccgccacgtcagagatgaactctgtcgcgaattgcggagcgtccatcaattcgtcccacagttcactatcgtcggtggcgtccaacaagcgtgatagcaatgagaccgattggtcactgtttgcgcccaagaccaacatcatgtggctgcattacctggcaaccaagctgctggagaacaagggcctgtcgcacgtgaccaccactcggtctggacggctgtcgtttggtacctccaacacgtcgctccgatcggcgtacctcgctggagaaactatggaggctggtcatcacatgtccaacccccacgaggaggctcgggcatgcaagtcgctcaacaccgtgactcggtgcatcgatcctcgacgaaagaagctaggaggcaagcgatccggtaccgccatggtgttccaggactttgactccgcgtctgacgtgctcgaatggggcttcaagaacaatcttattcccgaggggctgttgtaaaaacagaacccagtttggagcagacaaaatcactatctatacattaatattattcatgcgtttttttgagttggtgcagcattgggagcggtcatctgggcaaagatatactgactgtaacagcgacctgctaccacgcctgtgtcatcacatctcccacgatccaacggtagaaaaaaacaaagatactcacataaggaagccatcgaagatatatcgaccccatcaggcggagttggcttactgtgtggaagttccaacaacgccagagtgggagagggtcgtggcgactgtgttgtttgggaagtggcacaaacagggttgggaagagcgctgagaaggagacaaggaaaagaatggtgctttcaagatgaataatgtgagcattgcaggcctaaagttgacgtgtgaagaatggtgctagggaaagctacgttggatctccctggtctgtgagagtgacacagctgatgtgttgaccgtgttggttccatggtgctgttctcgagcggtgaggagtaagaggaagaaaggagagaattgagttggtgtcaatgtgggatgaattaaggtggacggacttggtggcccgattgaggtggccggagttaaggtggttggatgaggtgtgctgcatgaccctgcatgattctgcattatctggcagagaaatatcaaggacaagaaaattttattctatttttatttttatgagtgaaatgtcatagggcaagtagaaaatgagtgcggaaatatactggaggatgaagtcggaaactgtagtggaagcaggaaactgtagtggaagccggaagctgtagcggttctatattactatttccgtggtctgaagattgacttggtggaagtggctgaccagcggactctaccaggttgctacgttataatactcatttagtgttggaattaatacccggtaggaggtggaagattcctcactcagtcatgagagggacctgctggtcgtatacgggatgtctgtcttgtagatattgattttctgatacggtacatacatactctggtgtgtgtctatcggaacatggtgtccctagaagtgggttgtaagtcgttacaccaacagggatctaatcagatatatggtcttcattattcggtacataataatctgtttagtataccataccttcgaacagcttgaagaactgcaacatggcattgaaaacaaaactgaatacaccagttgttaagacgcgcaatgcaagtgtctcaattgagattgggggactaggaagacgatgatttgtactacaagatcatcaactcttgtctcttaccggcagttttcgtaatcgctcattgctggaccatcaattgctgggggtacaacatattggtttgcggcaagttgaaggactcttgagggcgagctgccaaagttctaccgcgtgggttcacaagaaggagattgtcgtgtgtaccctcagaccaagatctatcaacatcgcttgcacgctgttcaatgcaatactggctacgagatctacgcatcgatatgtcaaacaagcagcgataacttggaaagatgatctatatttcaacacactactctagttacttcactgtcaacctctcagagactccctcaaataccgactggcacttcttcgtcgcagctcctttccataaatgatcataggaacagttagaatcacaggaatgagactgagacagccggccgaaacgtaggtgttttgcaatccaatactgtctacccatgggctcatgcaaaagagaatcatcatggcgagtccgtttctgatcacaatgaccccaatgaatgcgtctgccacaatcttctcgtagcaatcaactagataggtgacgatgatggcacctgctgatccgaagctgaaggctacgacggcaaaccccacagtgggaaccatccaatgaacgtggttagcaatggaaattccgaacatgaacatgccaatggtcatggtgaagtttgcgaaaacaagactgtagagtcggaattccggctcgtagacaccattgttcctcttagagagccatatgatggtcttgtcgttgaaccagccgccgtagatacatccaaaaagacatccaatgaagggcgaaatgttcacattgccgattccggcggaagagaagttgtaaggtgggtctgcaaacgagttggagacggtggtggatgccatggacagaaatgatagcaaaaagccgtattggagagctgaaaaggaaacaatggggtaggaaaccaaggtgagaaaaggagtgaagagctttcgaacaaactctttaaatgagccggggttgtaggtaaccagagcgagtctcttagacaatgggttcatttgtatctccgggtcgatgaagacttctctaacggctttttcggggggcgatttgtccgatccagtcttctccaactgtcccatcttctgctcgtctgtctccgcctgttcggtctctgacatgtctgagaggtcagtagaaacaagcaccacgtctggggccgtatagttggtctcttcaaagaagaagacggtcatgacaaactgaacagcggcaataatggccacaatgatgtacacccatctccagccgagattgacagtggcatagcccgcgggaactagcactatgaagttgccaaccgctaccacgagcatgtagatgccattgaaagttcctctttcgtgcacaaaatacagatcggcgactgtcatctggatgattgtttcggtgacactcacggccaatccctggagaaactgagagccgtatgcttctccaatcgagttcatgccggcctgccaggctgccgtagccaccaccagagccgaggccaccaggtagacgggccgtttgccaaacttgtgggagaacggaaccaaaattggacatcccagacctaggccggccacagaaatggcgtaggtgttgttcagctcggaaaaggtccatccgaattcggcctgccacggtccccacaagacagaagacacgtcggaggccgtgaaggcgatgagggtgaagaaacacacaatgaagaagttgaggtgtttgcgccatcgggcccagttgagaggttggttgggatcgcagctaggagcgggttgcagaacaatggagtcggaggacgtttccagaaccaccgttccaggtggctcgagagcggacatgttttaggcggtcaggtcaggtcgggtcgggtcgggtcggatagaatctggtctggtttgtcgtattgaagtggcatcaatggttgttatatagagaaggagacaattctttccatagaaattcacaccaaagagagatcattgtggctacagattgtatcagagtatcatgatagccttagatccaaagtaaacttacagggtctggaggctagtggtacggtatgagcacggtacagtcttataggtatctagagacgtgtctggttgtataataaatgttttctacaggtaaatgtatctaatcgcgtctgtactacatattcaggtcttcatatacaatgcactgactccctgtcgtcccatccacgacgttgaaccaatggtgcaagagttaatcagacaactctgataagcctcgttgcggagatgccatggtctccacagaagtcaagatagtcgatacttccgctaaaccacgtgcggagctactgtattgtgttcttctaagacatcccaggcggtgggggttgtgtgaggttgtaagagtatggggaatgagaggaaggagaatgagaagaaggagaatgagaagaaggagaatgagaggaaggagaatgagaggaagaagaatgagagaaatgagaaaaagaaaactgagagaaatgagaggtcacacaaaagggcaaatttctagagcggaaaatgagctccgacttcgcacccaatcccccaaagtgagacatgtctcaccctattaaccttgaaataagtacccggaccaaacctccgtggatttctcttcactatcggcagtagctctaaactagggtctatctccgcagcacttgtctcagcgttatcttgctaccgggaatatagatagtgcagctcaactatctccgcttctcttgttcttacctaacaatcttcaattccgcccaaaaagaagttcctcgagatccgtggaatcatgaacagattgacaatctcccgtacaagccgcagataggccaaggccgaccgagaaagctcgtattgatgcgaggtttccgaacgtggtagtgacattgtgtattgtcatcatatgtcatctgcaagtcgtactactgggtttcaatctctagccaaacgtttgactgtctgtatccagttttgttagcttggtcgagggttcagttagagggaagacactatggatatcaccaaagtactgtatgtactacggttgtagaatatgaaccaaatgagaggggaaatggatccttggagaaaaatatgacaattatttatttacacctgcattttcttgacctctgagggtctcagaatcgcaatttgcagaatcgcaggatatttgttcaacaggaacgcatgagactgctactgaggcggtgtggggctcctggaacagcggaatctcctagaccagaccccgtttctagtttcactactactccttcggcgacaagcggagatatcgaggatcccatcaccaaccaccagtaaactccaggaagatcttaccgcccttttctccttgtctgagcaataaatgaatgctggtctgatcacgtctagtcaggtgcacttgaccagctaatgagccttcatcaacacacagagaggatcccgttgctacaagttcggggttccgatctgatcatgatccatactgtcgtttgcatcatttggcatgatgatcccgtacgacaatgtgatgaaagatcggattatttttgtaccagtctcgagtgaatatatctactaattcacccccattatgtctatgatcaattatgacggtctcaagccatttccattggcagttcttttaaagcggcagtttactactgtacatacttgcaggagtacagcactgtagctgatatgaaccagtttttctcctggtttcacgtgctgtttttttcccccattttttttccattttcccccatttttttccatttttttccaatttctcaatttcaattttcaattttcaatttttccattttccaacttttcaatgttttccaatttttcaattattttccgattattttccgattattttccagtttcaaacagaagtttaaatataacttatggattttaagtcgaaacccgcacaatccctccttcatcatcgatacccttgacctgacagagacacttttggattccctcttcgaattcccaaagcattctattccgtgatatctttctttttctcttctcttggtaatgctcaacaacgacactctgagactgctctatgaagagtgctgcttggaatcgtgtctagcacttggggaggtgtgtaaggcgtcgtcagaagtgctggcgtcactcgacaagagcctgattatgagaaaggtgcaggaccgagccccctggctcgaattaagtaacgaatacttgtcctggacgaaatgtgctcgtgttcttattgccagaagcaaaaaggctcaggatggaaagtacgacaagttaaaaatcatcaccgaccttcgacaagtggactcagagagctcaattgatcttgtcagtgtcgaaccaactgatgtcggtagagatgacactcttcgacgggccatgaagcccttgttcccctattcccggttgcaaaacttgttaaaacaacaacagtctgtggtcgaaggaaccaaggttctttgtgaacttcaagagctagatctcaccaccatgacactcaaagtgagtgattacgatccagaagacaaactgtacgctgagcgtaaccgcaagcccgtgtctacagctccctcgggcctgaaagtgaggcacagtgaaggtcaagacgtggaggtagtggcggaaaacaagaccatgctacaggttcaatattatgtgggagacaccgagactgaatttgatgagattgtgcacaaggcttctcagcctcgagacgaggacggaacacttgttattgatccacatatgaaagccccccgcatcgaggccaatttcaatgtggatatgggcatggtcaatctagtaccaggttccggtggagctctcgtcatccagcacttcgttttgaatccagaaaagtcttacttggggtacattgagccctcgtctgaaagaagagtcgttgaactgtgcaaaatccccccacaggtgcaaactcagggcattggcttccaccaaggcaaccagtggttctacgttctctatgatgggttcatttacatttacttgtatggccgatttcttcagctgtggattgatttgggggccggtcaaaaccgggctctgactgtctggaactccgactttccggctattggcccatttggacatttcagagatcagagagccacatggaatattacccagggaggtctaaatgacgatcaaaggcgatttgtgacgatcgaagatgagccctgtggatgtgtggttggagacctccacacgggaaaaacgtactattctcgagggtcctacaagagccccaagctgacaatcccgtttgccacagagtcccaaacagtcggcttctatgtctttgatgagcaaatctgggagttcattgataacaccatggacagtctttatgggacagcgaccaactatgacatttcgctgctttacgccgccttcttggagacacatcacaagatgttggggttgatagagacagatgaggagccgtcaaaggagacactagagaaagagctcagagagcatgtgtgttgtttcccccgagatgactctgactatggagattatgaagatgaagatgggcaggaggaggagctattggagatgttggacgatttggaagaaagggtggagaatttgaccatttaaggaaaagtaaatcgcagtttacgtgtgatatcggaaaatgacttgattctcgctatcaattaagtaataaaggggtatttgagagttatacaatacaggatgtttgatccagctacatcagcagcagaggcagaagggcaagagctccaattgtcagcttgtctccagagttggcctgggcaacagtggaaggaaccgcgaccacagaagtgaagttggcttgagtaggagccaacggggtttcgaggactctggtgacaagaatagttccagtgatggtggtggtgaggccgctagacacgagagtcttggtggttagatgagtctccacggtttcgacgggaatgggcaggatgtcaggggaatcggacttgataggtttgatggtctcaacaaccttgtagccagagatggtcttggtcttgatcttgggctcaccagcgacagtgggatcagcatgaacgtactcggtctcaatctcgcagggaacgacaactgtgagggtcttaccctcaatgacagtgggacaggtggtgacggtgtggatgacggggacacaggtggtcagagtgacgacagtgttgctgcaagcgctgttctcgcagtgggtgacggtctgggtggtggtgagggtagtggactcagcagtagtgtttgcagcgatgggggagacagaagcagaagcatcaccggagacagcggcaccagaggaggcaggggcgtcgccagaggcagtagcagaagcagaggcatcaccagaggtagcagggacattaccagaggtagcagggatatcaccagcagaagagctggaagcaacttcatcctctgcgttcacagcttccaaccaagcctcaagctcggcaatggtgttcaaaacactgtcgaggttggcctgaagagcatcagacttgttctcgatgggctcaataatggcaacaacagctcgcagctggtccagaagagtcacgacatcgtcgatgaggtcagaggcggtatctctcttggcaatccacatcataatgtgtctcttggcagcagttgtggcctgcagctcagctagacggctcatgacactgtcaagagaagcggagacgtcagccacaagctgctgaagctcaggggagtcggaaacttcggcaaggagtgtatccagagtgtcctggagaccagcaatggtggcatcgagctgcgagagctcctcggctgtaggaggagagggagtggtggtagaagtaggagtaggagcaggggtgctagcgtcgacgggggtggagtcgacagtggcactaggagactgggtggagctcacgacagaggcaacgggggtggagtcaacggtggaactggtaggcagggtggagctctcgaggagttcgacaggagtagaggcaccaggagactcagtggagctatcgatggtagtagaggcaccaggagggtcggagatgatgtcagttgtgttctgagccaagacagctgagacgagagtgaggggaataagagacagcttcatgttagcgagcgagtgaatggagagcgagtgaaagagtgactggggattgaggacaggcaagttgggggtttatgtaacatgtttgtgtataacatgatgagtttgtgtccgtgtttctccttccaagctagcccagaattgtgctatttagttgagtcgggttttgttgattttagcacgggtctattgtgtgttccgccgtgtgctattgttaggcggctgcacaatggcgatgagccatcagtcttgccgtgcatatatctatagatgatcgatatcatatcggacaagatcacattgaccagatctcatttatcaaaatcatctcgatcaaagcccgctgatcaacatctcctgtaatgaagacgcgtcgcacaaccaatgtttcgacgtgctgacagctcgcccacattcatcaggggggttccaaaacaaggcaagaggttttccgcctactgtatcggatatgcgggtatctgattatgggtatagacgtcggactaaccatgtggcggtggggttggggtgagagatgtggggatttctgcttggtaaaggcagacacaaggccacaaagaagaagaggcggtgctgtgtaacctaagctggtgctctgtgtctggaaaggggggtgttgcaacgctcggtgtcacgaaatgtcttctcgaaactccagaagaccgcattgggccgaaatactgggcggtaaacctttttatgacgctaaaagttccgcttctcagcattcccaggttcccgtgcccccctggatgtcatctctcaggtcgactggcattctttgcattctttcagccgctttggagagtcgtagggtgcggttagtggagaagaatgtccactgtatcgtcgatggatcgaaacctgtacttgtacaactatatgatagaataaatcgatagatgacatattgccaataaaaagtactagctgatcatcttatcagtcttgcaactcgattttcctgtggaagatctgatggaacgtacggtacagtttcttcaaacgaccaaatacttggttatagttgtgaactcttcttatagttagaactgtgcgttaagggtgaactaatctcccattaaaacagttgaaccagctaaatactgataacaaacaacgtactgtccttgcaatacatgtagtcacaccatccagagatggcactaaaggatacgctgtcacgccacgcagagattgaactaaaagatacactgccactttgtacacccaatgtcatcaagaaccccatttgacacatgcttatgctaatgtaccggatgtacttgacattctttagatcagtccagcgctcacaggtgcttgccatgaatagccgtattagtgggtagaaacataacagtctctgaatatcctccacgttctcaactccccgtctctgaactccccgtctctgaactccacgtatctgaactccacgtatctatctaaagtgcccttcttgtggagggaagtcttccagcagcggttgcatgtcagagtggagaccaatagaatgatggacctgctaaaccgcagtcacatccaagaagtaggaccggtaggtggtcacaaagactcaaacaagcccgtaaagatctcaattggtccgtcctgagtatccagtataagcatcacacgtgcatccacatttcttgtactgatactcaacacctacacccctggtttgacacaacagcacttgaccagtctgagatcctcccataaagtccctttggtcgatcatctacatctgtttgtgctttacacatgtatccaagtcagtgacagtactctagatctattctacttgtatgaactatagattaggcggggtggatcctgccctaggtcagaactacctaagagaagtaggcatagtcacctccggccttagcggcggcctcagtgatggtagccttggccttggcggcatcagcaccgtcaagagcagcagcaagatcaccgagagcaaggtcgtcaattcggttgagcagagcatcgagatcgatgtcaatatcggcagacttggcctcgtcgccgaagtagccgttgtccttggcggcatttcgcacagctcgcttgttcttcttcttggcggacttggcagcctccttggacttcttggcgttctccttgttggcggcagcctcctcagcctccttcttggccttggcagcagcctcctcggcctcctttgcggccttagcagcggcctctcgggcaccggcctccttctcccacttcttggcctccttggccttcttgtcggcctccttgaacatcttgattcggggatcgagggacagagcaaggtcaacggcctctcggaatcgggcagtgtcctcggtcttgtgcttctgtcgctgggccttgttcttcttctcaatgtatcgcttgtggtctcggttggaagagtcatcgggaacatcctcgtcgaggtactcaaaggttctccacgagtcgaaggagtacatggcggcgtagaagccctccacctcggccttggaagactccatggtaccaagagaaggacagggctgggtcttggagaatcggatctcggagtcgaagaagggaccccacagctcgatgaagttctcggcggtggtctccttcttggtgggctgctccacattggcagcctcgtcgacggagtcgtactgtcgtcgtcggttggagtccatcagaacctcaaacgccttctggatacacttgaagaagtcgtcctcgtcgagcttggagccggaggcggccttcttatcggggtgatgcttgagcactcgctttcggtgggcccgtcggatctggtcctcggtagctcggtgtcgaaggtgagagatacccagaactcggtaatggtcctgagacttccagtccttggcctctcgctcgagatcctcaatgtcttcaggctcgtcgccgagatcggcgtcctcatcctcgccctcgacctgcttgacgttcttggcggcctcctccttctcgtcctcagaccaagttcggcctcgcagagttcgtcgcgcatgggccaggaacccgggtccaacgggctcaatctgtcgcttgacaggagaggtgaaggcggagtgggcaacaaagccctcggagttggcagaagcccatccggaaggaagagtaggcagagacatggtgttgttgtgctggtgtgaaggagagagttggtaagggtaaaagttttaccaaaatgtcagattaaggtttttttcaatcttattaagcaacggggcctgaaaactgctgctgtagagaagtgagactagtatgtcgttgtgtagtcagattaggagctctttttgggctattgtgacttactcattcattttttgccgttctacgtgccatttcacgtcacatgatcgcttctggctactttgaatgccttcccccacactcccagactgcaccctaactcacactaccaatacagtcctgaaaaaaatatccgacagacttgaatatgtcatgctacttctcacaaacttcacattggagacatcctacagtccagttgagagatacgctagggggcatttcactttcaatccaaggtacaatacagtagaaacaatacctctacaagtagaacggatatttactgatatgattcgaatcagagtgagcccctgggccgtttggtgatcttgatacttgttctctcctatacgcactctcttatcacttaaataataattaccataaacatatacaaaacccattcttttcataagtaggtccccttggaccagtcctgcttaatgtgcaggccaaaccactgagttcagacttcaccactagctgcgcgcgccattcgcttcgcccgttactcgcttagcactcgtcatctaggccttctgtccatcaacaaacgtcagcgcatcctcccgagtaatactcttcaccgtagaaatcttgttgttgaataagactccgtaaaacttgtcagccacgtgaatcatctcatttcggaacgtggtgcaaatgaactgtgtaggctgaggagcgttggcaatctgggaaatcacctgcgccacagcagttcgatactgatcgtcaagattagcgtcaatctcgtcaaacaggtaaaagggggcaggatcggaccgctggatggcgaaaatgagcgccaacgcacacagcgacttttgacctcccgacagctgctccactcgctgctgctcgttctccgtcgagttgaacgacacgttgatcgccactccagtgtacgagtcagggttctggtcgtccagagcccgtcgctcgatcaccagctgaccctttcctcgaggcacaagctgttggaacacctcggagaattccttggacacttgctggaacgttcgcttgattgctcggtccttctggtcgttaagagtggaaattagctcctcaatggactctgcagactccatgaggttctgtcgacgtgaaagaagtcgatctcggtccttgctaaacgtcgcaaattgctccagagctttccgattgacgtggccaaacttcttgagctcgtcagacacctctctgaactcctgcatcatgtcgccgtcgctctgggcagacacatcgaggaaagcatcgtcgggcagaataccaatctctcgaatcttggcctgcacatgctctcgtcgctgttcaagggcctgtcgcttggctgcaactcgctcggcagcctttgcaaacttggacagctttcgcagactctgggcctgctcatccttgagctcggcgaggtgagcctcgtcgtttgccacctgctgctccgcggtctccagtgctttctcagccgacaattgcttgctggaagcctccgacaactgctcctccatctgagcaagcttgcgggtaagcgtggcagccttctcggccagctcggcagcatcaaagtcgccgttgtgttgcagctccatgtcgtctcgagacaggtacaagttctgctgtagctcgttctcgagactcagacgggtcatttccagagcagacaccttctgttgaagctcggcgaccgaggcagacaggccaggaagagtctcgcagacccgctcgagctcttgctgctgagcagaagacaactgcgagctgaactcggacaccaactccgagttatacgactccagctgcgactccatcgacgagatgtctcgaagcagcgtctcggagttgtcccgcttcttctcaataagacccttgagggttgtgatggccgcggtctcggccttgatggactcagaggcccgctgccgggtctcttcaatctgctgcatttccatcagcagtttgttctgctccgtgtggcattcagacagccggtgctccacctcatcaacgctgttcttgatggcgttgatctgcacacggatctgactcagctcctcctgggcctcctgcacgtctcgagcagcgtccaatcggcttttcttggggtcgtggaaaccaccagtaagcacacccttggcatccactcgatctccacccaaagtgatggcgttgaggttgtggtttcgctgaacagcagcacccacctgcagattgatgcacacaatggtcttgccaaaaacttgctgcaccgcaggctcgtactctgggttacaagaaatcttgtcgaccagtgggaatacgttttcggcctcggggtactttcttcgctcggggttgagccggttgagaggcatgaacgtcagacgaccgcacttttcacgcaaaagctgctcaatcaccttggaagcaacatcgtcatcctcgacaaccacatggaaaagcgaattgccagcagtcacctcaacagctcgcttgtacttgtcatccagcttgatcaactcgcacaagggaccatagacctggtcctccagtcccagcttctgggccactcgtttcaggttagccaaaccaagggaggtgtttctgtccatggtagaagcaaatgctcgctgcgccttctcgacctgctgctccagctggtcgctatccttgagaagatacgactcctggcgccacaaagccttcttctcatcagcaatgccctctcgggcctgttgggaggccgcgtggcttcgcttgagctcagagtaccgcgattcgcagtcagcaaacgcttgtcgctgctccacaatcgcagcatccttggcagtgatttcacgctcgcactcttccacacttcgcttgccctttgccagggcctgctttcgactctccaaaaactcggagatctctgcaatctgtcgttgcagccacttgtcccgagcagccttggatgtgaactgtgcagatcggccttctcgggagagcagtgagtccttggttgccgaggcttctcgcagagctcgattggcagcctcaagctgacttttgagagcatcccgctcgctcacggtcgccctcagcgagctctccttggattcaatctcgccttgcacccgctgcaactgctgctcacgtgacagctcctcgtgctgtagcgtaccatggattcggttggtttcagcgagctccacctcgagggacgccttgagtcgacggagctgagcaacgtcgtcacgtgcatgggatgcagccagatctgcgtgctcacgtgcccggctggaagtctcaatctcagcctctacttcggaaatgaccaagtcctgctcctcgatcttagcaagtcgagcagctcggtcggaagcgccgccgtcgtccatgtcctgcagctccaccagcgcagtctccactgccttgagctcgcggtcctgcagcgcaaagtccaggcacttccgccgcttgtccagctgcagaaattcgtttagctcctgcttctcctcctccaggtcggacagccgcgtgttgatgtcgtccagtgcgctgttgatcttgagaatcttgttttcgttctcaatcatgagcttctccgactcggatcgccgctgctcgtagaccttagtaccagccacctccttgagcagcgccaatcgcgtctcgtttttcgcgttggtgagcgctgtgattcgtccctgaggcacaatgtagtagggattggcccgcgagaagcccgcagactccagcaggttcataatctcagaccgtgtgctggacttcttgtcgagcgagtactcgtccttcttggagccaatcgtccgtcgaatggtgacggtttctcctccggtgggcagtcgacgatcactgttatcgaagatgatctccacgaacgcactcattgtcgtgccagacatgccggagccctcgtggatgagagcagcccgctcctccttgttgaggtggttgtaggcgtcggagagaacgaaccggaccgcggcaaagaagttggacttaccggaaccgtttcggccaaccaccacgttgaaccgtggcgagaacgggtcgatctcgaccaggtttttgtacgacttgaatccttggattcgaatctaggttagtatcggcaccaagtggcgagcgcgaaatttgagcagaaagacagcggtcggcgatctggtcacagtagtttcgttgtctgctgtctgttatacatcttttctgtgtcgtttcagcgtctgagcatcgtctgagccgcaaatttcggcccatcgcacgaccccctcggttgaatcacgtgatcagctgaataccatcccatccccctcagtctcatcatcacgtgaccgcccgcccttccacaatactcacctgtttaatatacatgtcgtggtgtccagtggtgtgagtgagtgtgacgagagacgcgtctggatttttacacacaattgggagtagagtaattaattccacaaaccttatgcgcgtgtttgggtgaggtgggaatcggtggagtagaaccgcgcgtcaggtctgtttgtggtgaatatagtggaggaatttgtgggtgttgggtcggggagtccctggctatatatagatggttttaagcgacacaagtagacgtttttgaggggatatcacttgtacttgtagcgatacatgtaggtattgtaattatcacctaaaaataataccatgcaactttaagcgcgcagggtgagaataatgggacgtgttagtgaggggctgatgttggagtattacaagtagtacggacagcaatattgtcagttgaagtatggatgataccggtagagactgatgtagttggtttggttgttgagttgctacctcacttgtactacagtacgagtcctgtgcgaataagccatatctgtaaatcaaaaaatcaggcccagctggacattatttggtgctacagattcggtggaaagtggaaatgtattaattatgccagcgtatatatatctacctatttttaaactaatctacgactctattaccaacgttcagtgtactattatgttcagagatgtccacacgcgttggagtcaagtatttcttgttagcgtaataacgtaactggttctataagagtctcaaagtgagaaaaaagacatccaattaagtcgcttgtctcctctaacactctccattggttacaatagccctctatacagccggtttgacactggtagacccccttcactaacgtccgtccccacgtgcatctaacctgcacctgcactcttttttgaacctccatctcagcatcaccaccacactactaccacaaaaaacacaaatggccgactcgcaaatcaactacgacgacgcaatttcgtactgggcgtcggtacctgctaccaacgacggtgttctcggcggctacggcaacacctctgtgccccgagctgacgtggttggctccatcacatttctccgacggctcaagacccgaatgccggtggaggagggcaagatcaagtacggcgcggacgtcggagcgggtatcggccgagtcaccaaggatatgctgagccaggtatgcgacaaggtggatctggtggaaccggtggagcagtttgtgaaccaggccaaacaggatctggccggtaacgacaaggtgggcgagtttctggatattggcgcccaggactttgtgcctgaaacaggcaagtactgggtcatttggaaccagtggtgcctgggccacttggacgacgagaatctcgtgctgtacttcaaacgatgcattgacggtctgcaaaagaacggaaccattgttgtcaaggaaaataatgctcccctggaggacgagtttgaccccacagattccagtgttactcgaacagacgccaaattcagagagctgtttgacaaggcgggtctgcagctcattctcacagaggtccagaagggtctgccaaaggagctctttgtggtccgaatgtacgctctgaaagtcaaggagtgaaacgcgggtatagataatgcattatggtggtgactggctggagtaccatagagtctcttgaggctgtgagatgcgcccatgtcgactagatattaattaaactggatatccgttctaactaattagtttaaacaattaaaatacacatcccagttcaacaaattctacctattctaactatccttaactaacttatgaccacacatttagctgagccttcaccaagcaatgattcggaaccaaaacatcccttctccaaagccaattcgtcgttttcattaatccaacaattttcctttttttttggctacacattcatttttatttttcagatttttcagattttttcctcttttcagacttttttcataatattacacctctatataacgtcttggcatacaccattgcatatttcgggccactgaggttagtaagaaaaccggaaaacatcgattagaatcgataaaaatcagataggagcgaaagacatgctaagattaattcttcattgatagtcagatgaactatgcgaattcttaatcatcatttgcgggtttcgatgggaaaaggcgtcggtactcactgtttgtgtctcaaagtgacaaccaggagtccaaaaaccaggagggaacacacatacgattccgcgcgtcgcagagcatcgcctgtgtgtcttccctccaagataccgggtccacagttgtcactgttgtgagattaaaaagtttttggacagcatttttcatcccaactatatagactttaataaaaggagggtaactcaaataccctagtcacgtggtacaccttattttgctgttctcagactgctctgcggatgttgggcaatccgtaaatgaaaattggaattgaaaatcaaaacgaaaatcaaattgaaaatcaaaccaaaattgaaaattgaaattaaaaattgaaaatcaatatatatatatatatatatataaatcaaaacaataaacatgctacaaacacattttatacttactatatgacgaaattaatgaaacgatccttcgtaacacccacaaatgtaacccttcgcccatcaatatggtcagaccacttcataatgctgctgtcaaaaaacttgcctccaaaccacctacaatgtacttgtacttgtatattctagccgagagtgaaacatgaaaaatgaaaactgctgaaaaatgaaaactgcaagctgaagatttattgatattattatcaatcctgaacttggtacgagtacggcatgtagatcgtatgatacattcgtatcgtacaagttcaggatcgtactcagtatctgatccatctcaacacggtatcttgcttattggacgcattttctacaggactacggcacggtggggatttcggtttagaggagttctttttttggttcttttgatcataaatgcaaataaataagggttaatgaaacatgactcaatggctctcttgtatggcgcaagctcagacggcttactcggccgctcaacctcctagttcatgccggagttggagtaggcggcaacaagcccaaagccctggtacttgttggagttctttcgcttgacagagccgccgtcaggagacgggcccatgtcctgggggctggcagatgccagctgggcggcgattccactgcccccggcagcgttggatccagcccgcattcggccctggaatccaccggcccgcgacaggttcatggcctcgtcagcggtgatgggagagccaggcgatcccaccttggagaagttgggggagtggccggggcccgaaggcagagaagaggacacgggggcgggagtgccgcccgaggcagcctgggaattgcgccggaactgctgcagcttctgcttatgatcctcctcctgcttggccagggctgctgcgagagccgacgccttgggcgacatggtcggcgacattgccgagccaaactgcgacggcagcgactgggccaccgagccgtagacggagccgctcacggactcggacacagactgggggatgtcctgggagccggatgggggctggttgggctggggaactgccacgggggtggactctgcgttggcagagccaaagttgttgcaatcctgcttgatggggggccggctctgctgtttgggagcggcgtcttccttggatccaaagaggttagataggaatggcattgtggtcaagtgtgagtggggggagtgttgatgcgactgtgtttatctgtttgcctagctgtgtgcgggttggtacgatgatgactgactgatgtgtttctgagtcaagtggttagttcttgtgtcgtttccactggctcgtggtgtttgttagtttccagtggttcgagacaggccaagaacagaaaacagaaaacagaagactgagagctaagaagaaaaaaacagaaatagagaaaaaatccactgccacctgtttgtgtcgatagtcttgttgtgctcgctgtgcggattctcgaggtgcaaacgtgtcggttggaagggtgggttggggtggctgaagttgtgtcttgtgtggagaaggataagttatatatctggggttaaggcagacttgctattaggttttgtgagtcagacgttgtggggtgaggaaaatcggacggtttgaaaggggtgcgaaaagcaacgagcggggcgaaaaagcggcatttatcggccactctgcgtcttgtttgccaattaatgtggtttttaacccatggctccatacaaaaaagcgccataatacgcggttttgtagaggcccttttttttatgggcgacttttttctcccaaaaaatccgtcttgcctttttgactcaactacgtcatagcccccatacagtacacatgtgtatcggatgtcacatgccgagacacagcaaaagccgataccggctaaatggagggcgccgtaaaacgccccaccgaacgcgaatggaatggctaacctcctgccaccaaccgcacgcgtctcgaccgccgattgccgctctaaaaacctcaatttgatggcttggaggcttggtttggtgctaacaaaaagtggtcctgccgaggttgattcacggtagctagtcgtggtggtcacgtgcgtatggagaataaggttggttgggagttccaaagtttaatttggtggcgttggaggctggaagtgcaaacctgccgttttccacgtgtgaaataatgggacgttgaggaggtggatgtgtgatttattttttttatttattttttattttttcttttttatttttgattttattttatatactttatttttattttatttactttatttaatttatatttatttattcatatttttatttatttattcatatatatatttatttacttatttttaaatcaccctatcctccgaaaatccgaaagtataattgacagtacctcgctgactcagctggaatgaggtttgggaggaattaattacagagccgaaaaatggtaatagcgcggacagagaatcgaactgcgaccgcttgaccgggaacagtaactctcaatactgggaattttggaaaatattttttcaaaaaaaaaaaagaaataccaaataatgctgcataataacaccatcagagcgataatattgggtccagataatgtaagtcggttgttatccgataataagtggctaaattgaatgttaaacggagctctatgcagcaacaaggtgatataataccgtggaatgaccaacttcagggaacctgtccatatctcagatgtaaaagtacccggtaacgaccaataaacacgctgaggcgactcggcacacctcgctacaatcgtactgcactgaacttgtagacacattctagttgcgcaaggttcctacaagtatgtaccctaataacttcagactcgggtcagaaaaagaagagacaaacatgagtctgtttaggcgaccaaaccggatgagggcaccatcgacgatgttttcagtcggttgccgggcgctcattgtcgctcattgtctcaatatccttctcctctgtctcgtatgggtccgcctggtgtctctatctccgcatatcactgcggtttaactctcgcaaacccaacactatgttccattcctacagtgagtatcgaatcaagccgagtttcgtgccatgtgtttggtcggagatgtgaaatagttgcagttgtcgacccaataccacgcacgagtatgtacaagtacttgtacttgcaaacaggtggatctcgccccgaatgacaccttggttacaagtacttgttagatctgttcactccacagtaatattcactcaccccacctatatcactcaactccactgacaccaacttatgctgtatcgccttcaagtgacggccgtacaaacactcgtacagtactgtaagtgaacgccctatacaaacaggtggcagaagtcacctctttcggcacaggcagcgtgtttgtgtcagccgtttggaccgttgcggacttgtgtttccctttctggcaccgtggtcgggtcgagacaatgtatcgccgtgtataggtgccatttgggcgactctccagctattgcgtctcttcataacaaatccgccttgcagaggggctattctagctccgctagggtttcagttaggttcccataagctaattgtcttgttgcgcggctcttggtgtggcgatgggagaggttgatgagagaaaaaaacgaaaaaaaaaacaaaaaaacacgagccaaacccagtaggcccgaaacatgttgcagtgcgagatttgagacctctatttttgcgtcaccgccacgtagcgcgaaaccggtctacggataaaacacttgcaacccccgccaaaaccatacttgtatggcatgggcagtttggtgtcagtaggaaaacaccgcatatgagacaggtgggaaaaagacgaaaaagatgtgcaaagaaatacaagggttgatgtgcaccgacaacaaaaaaataaaacaataaaaaaaaacccacacagaggctgatctccggtggggaaagataactgacgataataggataatagtgacggagaagctttccgcaaaatcctctacaagtaggcaacctggagcaaggggcttacaagtacacgctggggtgagggtgtaggcatgtaggagagcatgcagtgcgatgcaaaaacgcacagatatatttagttagacgaccacgcgtcatgatggccctaccaacatggtccccacaaaagatgcgtctggaatgtacagtgaggtaaccggccgcagaggttattttggctatttgtagggcaaaaccggtaaaaaaaaaaaagaaaaaaaaagaaaaaacagaagccagcaataacagtttccgaacgggcagaaaaaagacggatttatatggacttggtgggggtcgactaaaatctcccgttaaaatggtaccatctgagccgcttaactgcccactggttgaattccgatgatattcaatgcaactcacgctcactttttttcttcatctttttgttatgctgatcgctcggaacctacggggtttacctagagtctatgaagccccccaatgtaggtttatttttgataattcaccgccatggctgggtttctccacgtggacccagcccggttgacccaagtctttgcgaccgcccacaagctccattttcgcggttgctacgaatcccaacctcatgcctccgtgcagtattacatgtcgctctgctgcgtgcgggtgcgctgctgcacgtcccatatgatattgtgcagtcggttcctgtggctacagattgtctgccttgccaaagttagactttttcgacattggtctgatgcataatggtgcatggaggtgcaggagtgagggctctaccgggacagcatcgtgagctgacgggcggctagcgggcccgaaaaacacacacaagaatatgacgcccacggctcccagtccatctggacggtctgcgggccaggttgtcgtacattttggtccagcaaccagcccccccggaaataagcgcaaaccttgtttaaattcaaagcaaggaagagtgaagtttccgcttttgctttttgcaacttgtctgggattgccgtggttgtctgggggcaaagtgaaggctgtagatatttggggccggggcctgggcgcttgtggtacacaaaaggagccccgatttctcgctcccgatactctctccagtttcaaacgacaccacatgtccaatgccaatgtcactgctaccactgcgcctagtactcgtagccaggtacaagcttcggaggcacatacatatagtggtgggttgacgcagacgcagctctcgtcgcaaatatccactcctctggcttcttccttaccatctccattgccagacacagacacagagagatcgatacagacaccgatacagacacaaccgacacagacaggatctagctccacgcaacaagcgacatcagcgacacaaacgacacaaagtactccagcgacacaaactactccaacttcagctacacagacacaaacacaaacaccctccagcacagacatgaacgtttccgagtcgtccactcttttgtcctcaacccatgtttcctcacagctctcttcggctgctccggtcagcagcagtatagacacgtcttcagcgtcttcagcttcttctgtgacgactgccacaacctcggaggcaccatccacaacatcttcagagacgcccaccacgtcctcggagcctcccaccacgtcttccgaactacccaccacgtcctcggagcctcccaccacgtcctcggagccgcccacaacctctgagatacccccaacatcgtctctgccacctacaaccagctcggagccccccaccacgtcatctctactagaaacaactacatcgctcccccctactacttcatcgctcccccccaccacgtcttcgttcttcccccctaccacaacctcgctttcgtctttcatctcctccaccttttcgacttccttcttgtcgtcagtcgagtcctctgcattgtttgatacctccagtgagctttcgaccacgtcgcttgaacccacctccgagtcgtccacgtttgtggcccccacaacctcctcggtcgaacccacaagctcgttcgagcccacaacctcctcgttccaacccacaagctcgttcgaacccaccacttcttccttcccccctacaaccttctcttcctcttttatttcctcctcggagtcctccacctccattttcattgccccggtcacctcgtcgacgtcgagtacttcgtcctcgtctagccccagctctagcagcaccccgcccagctccagctcctctactagacagtcgaccacatccagttctacgacatccaatagtggtactagcacaacttcatcgagctctacaagcagctcttcctcgagccctaccatcacaagttcgtctaccatgtcctcagccgatcctacagatctttcagtaatagataccattcagacgttcactcagaccgtcaacggtgaggttataaccaccattgtgactggcagagccactgtgacccccacagctgctattgctcaggccacagcttcttccgatggtggaggcggcggcggtctgcatggaggaagcaagactgccgttgctgtcgttgttcccattggaggagtggctctcatttctgccgcggccttttacttctggaagaagaagtcgcgaaagacctttgccgaccagcgactcagcacctcgtctcgatcgcactccccctcagactccttctctaacactctgagtaccacgcagctggctggaggagcgggcgtaccgcagtaccgaggctgggacatgaccgggggcggcaacgctgctgctgctggcaacggagtcaatggctccatcaactcgggctctggttcgggcctgggtctggtttcggctactggtgctggcgtggcctcttccgcctcgtctaccactgccgtgggtcccactcgaacacaatcgcgtggggcagcctctcgaacgcactctcgagcagcctccttgtccatgggtcccattgacgaggatctggatgccgacggggctgctgtgggagatccgttcaagtctgcggccgacgaggagtacgagccttctcctgatacacatggtctgaacatgaataccagtcatgctcgacggccgtccaacttttccaacttttccatgaccggcgactcacctccagtcagtccgaccattggaggtatttcagccaacttttaggaagagccaccacatcacattttgcatatagtcagtaattcatattttaacagagatggagggagggtagttgtacattggtcaagtattaaacaagtgagtgttctaaggattaactgaggtgggcattgctacttgtaatcacttgtacttgtacttttacttgtacacttgttgtagatagatggtttcacgcagtctcccaaataggacgtctcagtacatacaggcctgcccggtttgggctttctcaaagggaccagaaaggacgacaaaaatgtctcatggcaggctctcgagatgaatatgcggtgatgctcatgctcttgctcttgtgggtgtggattgaggcgacaggaggagagcttgatacaggacttcgtgaccggcgtctgattacataatggaatgttctcaatgaacgcgtaattgtagggaccttgtacagctcgagcgttcacttcccgcgccgtgacgctcaccccacattccagggcgtattcgtgtttctacgttagagtctgcatgcgtctgtttatccggtttcgtctgatttcccccgtttgttttttgcgggcatttccatctcttcttggcgactcggtgatcataacaacttagttggatcccggaaggttaactaaggcggcgtgctgcgagttttcgcaaagagaccggaagggagccattttttgtagttttcaagtaagaaatcaactttgtatgaatgtggaaacatgttgtgaaaatttcaagcgatttcgacctgtttttggtctagtttaagccatcccaaatccaacgattgtttaccgccttgcagcagggttcaaaacgctaacgcctaagttcaatatgcgcttcccgacggagaaaatcaaaacactctacaggtagggtctggcagttgcagcgagtccattatgggccgagaatggacagggacgatctccgtggacacatgtcgggtatcttgtccccgttgcttgctatgcacaagtgagcactataccaggggaccatgcatggttctgctcgcacaacgcgaaagatacgagaattgcgacaagtgaccgtttgggtcaagccgcagggttgataagagcaatctgaccgagtttggaatttgtaacgttcaaattgctcgttatggaagagatgtagttgtgcgcagggcggggatgaaagacagataaaaagtgcaatacgggagctacgaaaacgacgagactgccgttggattcgccgcctccggcttatccagagccttgattttcaccttgcacttgaacgaaacatggttgttgctcgcgctgatagtatacaagagataggctagaagaccccagcaatgtcaaaaggaggcttctctctggtatcggttgcactagatagttgatttcagtgctgagtacagtggctaactcagctaccgttctctctagctgtagagataatgattgctaaacaactacttgtagccatccctcgatgaagagagaaacttggtacaagcatgtagtgtatgtacatactgtacatactgtacttggatcagacctagtcctggactgcaaatagttcatcgccataagacccagacccgttcacagacaggtttcctcgcagtactcagaacgactgccagcagagaaaacatacactggatttttcggcaagtgaaattgctctccagctgaactggaaatacttctcaagctctgaagagttgatgccatgatgagggcacaatgaagagatatcatggctctataactgcatttggcgacgcactagataaatgtgggaagggacaaactgtcgacaatatcgctcatgatgttcaagaaggctactgaatctgaatgatattgttcagggctcatacgagacattgacacagatcggagaaaaggtataagacagctcttccaggcccaagggcagaatcggaaaagggaagcagatttgggtgaattgatgatctttacgtgccgatgtactcaattaaccactctcggtattacttgtacttgttccctgtgaacttgtccccaatcattcttagctcgacgttttttcgacatcctaagtctgcttcactcaagaccggaaaataagtcctccgaagatgaatactcaataatatgagacaaaatgaatcttacattgacgtcaacctgtatcccgttcaaagactcggtcggcaatggttctttgtcgttgagaggcagtcgtctgatattgctactgtcagaacaagaaacagatattatgatgctgaccaaacgggtatcttgtcatatttaggtcggagtatgtttgatattgactccgaagatacaagcgatgtcgaaatgagactagtgatgcccggtcgccgctcgttgaagtggaaacgtgagacaagtatagatgaagggaaagaaattcaaaaaggggctacgacaaaactaatgggtcacttccgtgataatctaaaagacttttctccacttgccgagaccccggacaatctatcttagaacacaatcttggtagcagggcccaaaaatgagctaatgggctgtacagtacataccacagcctgattcgaatctactgctagttcagggacagctacagtgaagaagtgacttttagcgtactttctgaaaatgtttcggtccatcattaattaatattgggccccttttgaaccgtacaaccgcactacaagtaggtttcttggctgcagtagccaagattttgatacgaaatagagattgataatatgtctcataagtgacagaaatatcccattccaatggtgtatttgtgtctgaatggaacccaaggagtccttaattgcctataattcactcggaatatctgtaatacaagtacgaacacagggtcaacctcacttccatgaatgacctgcggatatttcagtcataatctctgaaagaaccactgaactggaaaaaagattagcccgacgtggggcttgaacccacagccttgagatcgctttgaataagagtctcacgctctaccgattgagctagccaggcagatgtattttcgggggggtggaaagagtaaatgaggttgaatgggggtctataaccaggccgaaacaggataaaattgagtagacgtggattacagagtcacttgtaaacacaagtattgtatgatcacttctacgcacatttcacccaaccatggagggggtaaaattagttggattttagtccaactttggtttaaaacgaaactgttggaggacttgatctccatgataacgtggctgtgaaacaatcttccacataccactgtaactgaaatcgaaactttttctgggcagtgggaaaaagatattcgcatgcaatgtattatcacggttcttcttgtacttgatatttgtagttgtagttgtagttttagtttgttgagcataacatctcaagtacgatcttcgggaattaaaaaagcacgattgaatggaaggaagaaaactagtgagatgatagaaacggtaatggcgatgagaagacaaaaaagttgaagcatataggaaattatattcactccatcatgtttggtgtcgttgaccatggttgtacagccatctgtctggttataatgaatatctatgaatgtctatgaatgcctatgaatgcctatgaatgtctatgaatgtctatttccggcttgttttgcaaacattatatcaagtgaaccattcgattcagaatctttcgcctttcgaccgataaacatccacatttcatcgtatttgcacttgaatgttctgctacaagtagcatctctatactggtgctggtggttcgatggggatgccaagcctccaaaatctaactgtgatggcccataaatatctactttttggtaccaaaataatccttgaactgagaagaatcatataatgaaataatatgaacctattaccacacaaaaaccaactttttcgcactgctccactccaaaaatgctccaaattcaaacgactttaacgttgcattcggggacattaattcgtggcgaaaccttgcagatttgggctactctaaagcaactgtcaaaatgaaccaccgaaaaagaggacgttattgaataactagcacaaaaaataattgtaccatcaaatgggcctgagagcctggatcacaaagagcttttaaaatatcaaaataacccatttttcggcccaaacttgcccaaatatcagttctgtcccaaataggcaaatgcagcaagagcagtctatcttcgcattatttgtactgaactgaagatctgacatatggctattattgtttgatttaatgataccattcgattcgtcaaactccatagattccgaatatcgactcagatacactcaatggcctctattgcgtctgttgtagtaacaccacctgatttagcaacgatgctagattttccccctaatgtattcaatatcatgataaatagaacaaaactagcatcattgaaaccgccagaccattctcatcaaaaagataccaatttctacccattttgaatggtggaattttttttggaagtacttttttttttcttagtatcatcgtgcgtacaccaatagccgtgtgacgatcacttcttctcttagatgcggttactaccgtatatatgcatctatgacttgtattaattatccaatccaagcatcatcagaacacacaacatggcccataatccccttttacacctcctgtcaaatcagctgtcaaatcagcagaataatcttcacgtcacatgacaagacgactggccccaaaacagcccggaggtcacgtgacacaccaaatgattacccgccaggggagaaaattagcggctgaaattggtcccccttttatctctcctgcgcccgttcagctggccacgcgcactgacatactcataacctatcacgtgtttcggcggcggcctcaattggctgcacttttaaggtgttgggaaggaggtgcatatttgctgcaattgggggcacgtgcggaggggaggttggatgggggcattatgggggatcggggcggaattgagaggttccgaccgctttgatcggtttgtggccccaaggttgacggtttggttcttttccgcgtctttttatgtccattttccgccctcctcggtgcccccaccagctctttccaactaccctccttcaagctcggttaagctcaatatgaaattaacgttgtctcttgtcatctctgtttgtgtcagatcagtcaggagtcgacaacaagtgagtatggcggcggtgaagcgactctgggtcgctcggcgagctcgtggaccaattctccagccacccagcatcccgctaacccagtgaaattcggaaagtaccttgccaaacggcaattggaggtgcccgaatatggaaactacttcatcaactacaaggcgctcaaaaagctcatcaagtcgctgtccaaccaggcggcggccggagggaacgtcgagcaggcgctgagagacaacaaggccacgttcttcttccggctggaacgagagctcgaaaaggtcaactcgttctacctgcaaaaggaggcggagctcaagctgcgaatcgacattctcatggagaaaaaggccgacgcgtacgcctcgggctcgctaacctcgtccacctccgtgtcgtacatctcgctgtacgagggctttcagcggttccgtcgtgacctgtccaaactcgagcagttcatcgagctcaacgccacgggcttctccaaggtgctcaaaaagtgggacaagcggtccaagcagcagaccaaagaattgtatctgtcacgagcagtagaggtccaacccgtgttccacagagacattctggcgcgtctcagcgaccaggcgtcgtcttccattctggagctggaggcctgggccgacggagacgtgattttcgacgactctcgacgaggctccgagatccaggccgccacagccccagccacagctcccgccacagcccccgtcacagcccccgtggccccagtgacggctcccggagccaaggacgacgatctgtactacgagtttgtcgaaaccgccagcgccgaaaacgtgacgacggcagacatctccgagtgggtggaggtgctcaagaaggtgcgagacgcaaagtcccgagtgacgcgtattttcttgctgtccatctccacctcggcgtccaacgcggctctcttggcgctctatgaatccggactcgttgatctgaacgccagcgacgctctcaacggccggaacgtgctccacgaggccgccatggcaacagctgtcgaccgaacagccattctggagctcgcagtgtcacagggcgtgtcattattggcacgtgacttttacggccgaacgcccctccactacgcctgtctccacaaccagcgaaagctgctcaaaatgtttgtggaccagggcgcggaggtcaacgcgctcgacaaggacaacttcacgccgctgctgtactccgtcatcaaccagtactccgactgtgtgcgtgatctcatctccatgggcgcctctgtggacgccgtgtcggacaatggatacatccccctcaatctggcgtgccagtacggtgtgtacgacgcgtccgagatcattttgcaaaacaagccgcgtcacgaacccgacgccgagggcctgtttgcgcttcacattgctgcccgagcaggacactcatccctcgtgagcctgctgctcaagtacgacgccgacgtcaacgagctggacaagctgaaccggtggacggcattgtttcatgccgccaacgagggccatgagcaggtcctcgagactcttctttctgccggagccagaaccgacattctggacgaggaacggcactcggcactgtactacgcagcctgggagggccatgtcaagtgcatgcaccggctggccgacctggaggcgaccgtcaagctccaggaggtggatatcgacatgaagtcgccggtggacgtgcagatcaacgacctgagcgggctggacgagctggacggaatcccagacctgtctctgccccctcccattcttcccttccgaagatatggccacaacttcttggaccagaagattttcgtgctcatcacgttagcaggctcgactcccgtgaagtttgtttctgaagaagccactctgtcgtctggccagttgcgaatctcgtccaaaaacgaccactcggtgattccccggtctgttcctctggccatgtctgatacagaccgagccatgtcgttccagctggactctctggacgactttgcgctggatttcgagattttccctacatttggaacccgaatcattgcgaaaacagctgccctgccctacatatggcgagccacccttacacagttccaccagagctacacgttgcctctgtttgacatgcgactgcatactattggtgaaatgtcgtttgacgtgcaagtggttcgaccctacaagggtactcctcttgaaatcacaaaatacgacacgtactggaagagcacaggcacttcgcagcagtcgctatcgttcgtcacagcctcgtcggtttccggacaatatgctcgtttgactatctgcgtcacttcggacggtgtgcctgtggtcactccctcctggaaggtggatgtgggccatggtattcgcgttggagtcaacactctgacgtatgaagagcttaaaaagtgcacaaacggcgtggttagcgacctatctacggtctctgaccccgtggaggttcacagagtgctctctaactccacgctgcctcttgcagaagtgctcaagctgctccccatcaccgtcaagcttgatctgaacgtgatcttcgctgcatctgacctcaaccattacgtggacacggttttggatgtgctgtttgctcatgcacgtgacactcacgacactaaccgcatgtcgaacggcgatcctgctcctcgagccacccggtccatcattctatcgtccgtcaaccccgacgtatgtactgcccttaactggaagcagcccaactaccctgtcttctttgtcatgcgaaatggtactttcaacgagcccaccgatctcgaccgggtttctgtgtctgtcaaggaggctgtgctgtttgctaacggcaacaacatgcttggtttggtctgcgatgcgcggttgctaaatctggtgcctgctctagtggagagcatctgttcgtcgggtctggtgctagtcagtgatggagagcatgagtgcaagggagtcaaggcaatgcgaaatgagagcgtggtggagtttcacaacagcattgatgtttaagtgaacatactccagggattgaaaaagtcattataacagacgttcgctcagtgtaagtcattggttatggtcattagtcatagagaataattattattataatagacttgttggggagttgggtactggtcaccaaggatgatccaaagcagtccaacaatttacgatatatggccgaatttgtaaattaatttgctaagatcgtttgaccagtgtttgtaggcttttgctgaggatgtcggggtgaattctgacgtgaaagggcaaataaatgaaccaaactaaatacagagagtgagaaaaaagcaggtgacgaggtgttcaatcgggtatctttagttgtgaccccatttccgtttaatcgctccagtcctcatcttcctcctccattttcttctccgcacgtcgcatgccgcttgttcccactctctggatgattccataagtgtagagcaggttttccagtgcgctgagctggaagttgtctgttcctccgagtcgttcgaagccaaccacccgggtagcctcctggcccttgatgtagcagactacaacgggaagagccttgagaccgagttttgtggcgagaaacggtgccttggacgcatccacacgtacgaaacgcgtgcccaagtgtcgtgctgccagttgttccagtttgctgtccatgattttgcatcgtgtgaaatcgggatggaaaaagtggatcacgcaccggtcagccgaggtggtggcttccagcacgtccttgtcgctctccagcgtctgtacgctgccgtggccgctctgtgcgccgtccttggcctccttcatctgtctagacagttcggcaatacgctgttctcggtagccctggaacgcctcgtcgtcgtcgagcagatcgagaaactcctggtcctccgcgtcgccctcgtccaccagttgcgagttgtacctgtcaagtagtgacatttgatgttgtgttggagtatgggtgacaagatcaggtgttttgccagttctgtatctgtatgcatggtaatatgtatggcaactttaaccgagggagatggtaaccattatgtacgtacagtacaaatatagtcggttattgtacaagtacaagtacttcgaatatgttgcaatacataaacgacgttagatgcgaccgtgatggatacatttactcagtggtgtctttttacagtgccatttacagtgtctttttacagtgtcatgttacattattcggagaacactccagtcgagtcgatcgattacagatttacgtgtttccggcggtcatgggtcccgaatcggaacaaaaacaattccagagtgttcatcacatctttatgatcgttttgatacctcttttgtaccgtttttgctgccctgtcttcaactgaatgctcctgttcagcagtgtctgccgtatgagctcgtgagaagagtactctggggttgaacatcagaaaccaaatcactcgaacaaggagctcgtcagagattgttctgagactcgttcgaactatggagaagcaatgggctagataagactttgtacattggtccaacaagtacagcactatacttgaacgcttttgttaacatcaatggtcttcattcctcgcaagttctgcaaaatcgacagagtaagtccctgttggccacagaaccacccttccaggtggtccggcccttcttggcccaggtctgatgccatttggtgagacaattgagagtgtatgtggagtcccggcaaaagtagcacccctgggtctaaatagtgggtctaatagtggggctaaggtagctcctatcgccaggttcaggaggttggtcgctagagagcaggcacgagagtagttgatggaaataaccggtagaataagacctgggagattcctcatgagatgcaccagctggttgtagacgagatatctgccttgtagatggtgtatctgatctagaatctctttctggtagcccttctggtgtgccaactaggctccctggtggttgactaaggctgatgggacgagaagccgtattttcaccagaatcgccgtaactggcggttggaggtagtgagggggctgattaagtcacatgagcgaaaaaaaagaccgactacgtgtatggtaaacaactcttctcttcactgtggactcgacatagcggaccatcgaatgtcattcatggttgacaacgaccagatagtcacctgttcaagtatggcatgtcgtgctatggaagaagcgaaagtgagagaaacggcattgaactattgaatagatactctgtaagtatccgataccgcttgacttacttggcagtaagaaggataattcactggaagatggccaactgcaacggcaacctcctcatgatggtcaaaatcttttacatcgccagagtctttgatgttgccagagaaatatttcaagtttgaagagttaaccgtcgcctcttagtctttgaatcatctctccattcgtcatctcctactattttgttgagttggtggttctacaacggactagacagtgttgtcaagggtctacggcataagtgacaatctacgacttcattgactgtatccggagtggtgagagtgattagaaggcattggtggccaatcacagtagtattcagttcttctgcgatcatgattgtcttttgtcaagacccttgtatcacgcaagatggaggtgtgcgactgtgactagcagcttcagtgcgacagcagcttcagctatatgtacaattgcacaaacccctggcaagtgtcacctaacaccatccatgccgacgatagcacggatggtgtttcagagagtggtagatgtttcagagaggtattgtacggttcaactacaagttgaaacagccgctacagtatgtactcaccattagcactacttaagcaggacggtcttgccgaagacgccagggacttcattctggaactccaagcaacagaacaggattctttacatcattgtatctatgcacaacctcgaggaacttttttctgtcatccttgtacaccgctacggagtgatggatgaccctaatgacatggacgtcttacggctcccagaagtcgtgccgatcggtggaagcatgatgtggggcctcttagactcgatcaccaaacagagacctcgagacgggagtgttcaccagcaaacttgccaccagacaacaagtctagatctttcaagttgatgaacaaaagacgactggaggtggcgtgaaccagatacggtcggtcgccagtggggagtgttctcatatcctaccagcgagggattcctaactcgcttttagcggattcagatatgtttagaaggtatttgttagggggcaatcagtatgtatatgaaggtcaggaaaacgaacgttgcactaaactatcctgaggaatgtcagactgaaaagaaatggtcatatgaagcggtagttgtagggaagatatgtaagcagttatctacagacagacactgagaagagaatagagaaccagagagatagggatccccagacatggaacaagggtcacgaacaacagctcagtagtagacaccttgagcaacacatcgagcatcgcttccaatgtattgttgaaatgattcgcatgtccgtacagtattgtctgttccggctgagagaccctgtcgcttctcaaagctcatttggatcaatttctcactctttgggagcttgtggcacgattttccagctggagttgcagttattgcggtgatatacaatagagacaatgaatataattgcggggtgatgtttttttttttttttgggacaaagaaaatgcggggttagcgagttaccctaaatttttcacatcttattacgcattaacgttcaaactttattttattttattttattttattttattttattttattttattttattttattttattttattttattttattataaaaatatttacatcacactcctctcctgactgtaaaattcttttcgaaaggtgacctgggcataaatgcctcggcggatcctcactcttctaaatcgatcatttaacccacattcagttctccagttctctgactagtgcatgacatgaggcagcgtgaacaaagaacggttatcagagtttgcctcatcgcgtgagcgagtggtaaattgatttacaccaattacacagcacacgaatacacgattgtaagactataaaacagatgcgaaatgctttctggttgtagttgatcgtgtagacgacgcgatctccagtgtatacttctcccattgccaattcggccgctcctgagacactaccagagctctatcgacatctgaggtctcgctgtgagaaggtcttggggtgctcgaacaggcaggtgcaatgtggcagacggtatagagaagagataggtatataaatagagtcgttttcttgcagattctactctttaattcgttgcatcaacaaaactcatctttctgactggattcaactggcagtctctcctatccatccccatcaaatcttcagcccatcagcacccatcaccataccccatcaacacccatcaataccccattaacaccctcatcatggcaataaaaacactagaacaaccacattcacccaaagaagctcgtttgaaacaagacacgcggttcgtgactcttccacagccggctccgccgttcctcgagttcctccgatgccccgcttgccagacgttggtcttgagtatcgaaaggagaaaccaccggttgaccaggtgtccgaagaggatgtaagggtgtgagcaacttgtttggatcaacatctgacggatatacatctgacgatatacatctgacgatatacatctgacgaatattcaagttctctaaaaaaatataacatgtgacaatcacccgcctctcgaaccatctgaaaccccccataccacaatacgctacaatcattgaagctcgtctaatgccaatgaacaccaagtacccacgttacgacatgttccatcgtgactttgtctgcggtacagctataactacacgtgaagctgggtttctcctctaccactttaaagacctaggaaaagtacatttatagaaggcggttgggcaagtgatgattgtacggcagttaatcgctccaggctgtatctcacatagttctgactacagtgtctgtacttgctaccttgctacttcagtgaacatacagtagtaggctttagttgggtttagttgggaatatatgtatcgtaagaaaaaaaaatgcggaaaaaaaaaatgcggaaaaaaatgcggaaaaaaaatgcagttgaaaaagtgtcaaatgatatacagagtccaaatgccagagaatttatctaaagacatcaagttacactatcacgcagccatatgtctactgcgaccagatcggctcttacgggaatcagtgtatattacgtacaaccgtccaaacctcttgaagcggcctacagtatcaactcacttcaatcagcaatatcaattttcatttacgtacatcttacacaatagtcagagcaataacaacgtaccaggccatttataacagtggcttgatgttgtccgctccagatctcctaatctccgagatcccttatttgattccaaaagtagtcttgaggtttctgagcaacagccagtcctctcggggcacgtcgtttcggaaaacggggtccttgagagtatcaatggactttcgggtgatggacgagtacagaacatccttctcgtcaatgtgtcggccccaagtaggctgtccggaagaagtatcgattcgcatagccacaccagcgttggtctggccctttcgaacaacagattcggacttgtggttcacctccatggaagtcaccttaccgagctcgagcacctctcgtgcaccggtctcggggttggtcttaacggcacagatgggggttccaattcgcagagagccctcaacaacgtcgacaccaatgatcatgggcgatcgcttgttgatgatctggacagtgtgcagaacacaagggaaaacggccttgtcgatggtgtccagtcgcttctgctcctgcagcttcttctggtgcttgacaaagtcgtcaaacagatggtagataatatcagccgagaaaagcttgacaccctgctcgtcagcatatcgctcggcgtccttgtcgatcttgacgtcgaaacacagcatgatggccagcgacttgtccttctccagcatggtggtggctcgcatcacatcctttttgtagacgggacctagagcaatggacatgacggggatcttcatatccttgaggaagtcgagaagagcctccagggaaccaagagtggaagcctggacacacacaccacgtccagacttgtcaacggagtcaaggaggccggtaagatcgtccatgacatcgtccatgagttcctcctcatcatcatcaggacccacaagcagcagacgagaaccagccacggccttgtccaggtcgttggcggcaatcttgacaccgagagcagccttgacctccttgtggtgctggtaagcagacttgattcgcagctctctgagcggctggggagtgagtagagctctgacgttggtggcaatggggccgttttgaccgcaaagcacgactcggtcaccctcgcgcaagacaccgttggacagaacaacatcgatggtggttccgaaaccttcgacaaccttgacttccagaacggtggcctcgagctcagacaggtacatgagctgcttggacattcggctctgagtcagctgcagcagaagagcgagcagatcgggaataccctcgccggtgatggcggaggtggggaccagagacacattcttggccaggttcttgttcttgtagtagacctcagagttgagaccctgctccataagagcggtcttggtcttctcgagtcggtcctcaaactcccgcagcacagacttcttctgcttggagagcgaatctcggaacgagttgttggggatggcctcccagtcgaagagtcgatcaatcttgttgagagcgaccacgaagggcgtcttcttgtctcgcagcagcttgatggactcaatggtctggggctcgaggccgtgcatgatatcaatcaccaggatggcaatgttacacagcgacgaacctcgggatcgcaggttggtgaaagactcgtgaccgggggtatcgatcaccagcagaccaggcacgtggtagtcaatctcgccgtactgctccatgacctccgtcttctttttgatggcctcgatagggaagtaggtggcaccaatctgctgagtaatacctccagcctcgccctcctgcacgttggtttgtcgcaccttgtccagaagcttggtcttaccggtatcgacgtggcccagaatacaacaaatgggagatcgcaggtttccggcattggcagatgcaatggctcgcgagtgcttggcggcacgcttctcggcaatggcagcagactttcgtcgggcctcttcaagagcctcctcggcagcaactcgctgtcgctccagctcggtctcgtcgttgagctgggtgccctcatcagcagccttctgacgggccagagcggcagcctgggcctcagcttccttggcagcagcctcagcctcctccttggccttgatggaggggtcttccttcttggtgatttcaatctcgccattctcgtcggccatggcctcccagtcgtccttgacttctccgtcagagtccagggcagtctcccagtcgtccataagggcgtcaacatcgtcctcctcgggagactcggcctccttcttgacctccttgggcttctcaacaaccttgtcctcaaccttgggctgcttctgggcaggagttctggtgggcagtctgttgttggtctgcttggcgggtgctcgtccaccgccaacaatcattccggcagccagcatctgctctcgtcgagcctcggcggcagctcgctcctgcttctgcttcttggtcatataagtaccctcagccttctgtcgctcgaccttctgtcgttctcgctccttcttggcgagccgtgcagcctccttctccttctcggcctcctcaacagctcgctgggcagcctcctcggcagctcgctcctcctcctcggcagcagccatagcggcttcctgggccttgatggcatcctgctgggccttgatcttggcaatagcagcagctcggccagtcagcttcttggcgggggcggcgggggcggcctcgggctcaggagacttggactcgaccttcttgtcctccttcttgtcctccttcttgtcctctcccttggccttcttatcagcagcctttgcgtcggcagcggcctttcgtgcgtcggcagcagccttcttcttggccttctcctgctccttcttgagcttgtccttctgcttcttggtcagaatcacaggagcctcctcgggctcggcctttgcgtccttggcgtctcgcgcgtccttcttcttcttggactttcgcagcgctcccatcagtcctccgccctcgaattcgtcggcaagatcgtccatagtggcctcctcgggagcggcaggggtgggctcgggggtcgcagaggcgctctcatcgcccttgggcacatcagcagccccagcagccttgtcctccacagcaggggtcccgtcgaggttctggggagtcgtgtccatgctctcctcctcactgtcgctccagtcgccgtagctttgttgcttctttcctttcttcgccatcttgtcgtgtcgtgaaaatggtcaggtattcaggttgagatgtgtaactacatgggtgaaaaagtgagaaatcacgtgatccaaaccttgttacaagaagacactgattgccctcaaagagcgggaaaaaaaagggaaaaggaccggtggaaatgtggcaaatccccgatatgagatttttttgtttgtttcttaggtttcacataactctggctcggctttgtcgaactaccgcaatccacttctcaaacatatcaatctaggccatatctacgatttccttgcatcatcattgcgccaaactaaagtttccttcaaaatttttcacagatcgaacgcggttgtgggttcgattctgtggtagataccatatagttggtctggatgggtgcgagcattgtcttgcgctcttctgaatacctggatccgagtccgatatgggggttaatattgtttttaggcctctgtagctgtgttgtatttcccctagaattagaataaaataaaaataaaaataaaaataaaaataaaaataaaaataaaaataaaaataaaaataaaaataaaaataaaaataaaaataaaaataaaaataaaaataaaaatagataaaaatttatatatatatatataaataaaaattagaaaaaaaaaaaaaaagatggcatcggactaaaatatgtacatactgtgcagtacttcttgcagttagtcttcaccttcatcttaatctttaagagagtaggattgagagtagtccaaacaagtggcattgtgaggaaaccagcgagttggttgccagtctccacaaatgaaacagtctcgctaccattcactctcgctaccattcactctcgctaccattcacagcttctttggtgaagtgatattgtcacggatggtcgcctagagactccagttgttgaccgcactatcaatgtccggaactacagtgtccagaaccccccgcactatccgagagtctggactgctctgctccatgtcccatgaaaccccaatcgtcgtctgaatgaagaaatgaagcaccgatggggctactagaacttcaccaactctcaccttgcccgacgactttacttgagatctgagtaccctcctcggtctcagccggtttcaattacgtcattattggatctcgggcaagtcatactctaccgcgcaggagtacgaggccatgaatcatgcccttgaacttgcatacacccatattccggtccttgttctcgtggagaagtttcccggtgccagcgaagacaagatccagggagttatcaactactatgggcaggatacattaagaatctgaacgtggccaagtactgggacaactttgacgccattggcgacctcaaggaccacatcttcgacaacaacggtgataaggatgcggatctagactacaccaaccctccccatgttatcgtgaactatatcatgcaggatcccgttatcaagaacctcattttttcgtgcctcatgaagtcgacgacttacgagcaaataccgatggggactgatggactttgccgactcttctactatgcctacgcatctcgactggtcgactattttggaggacatccgacacctgaaggaatccacgactgcccacgacatttataggaagctggtctgtcatacagacattgtctatctgcctggagacgccgacaactccaggttcatggagtgggtcaatgctatggttaaagtcgaggaggagtccacctttgcgagagaaggacctgagttctagagtgatctcaacaggcgcatgttggccaacttcaaactcgaacccaccatgaaaagacgagatcaaatgctgaccaacctgcgactttgagactactcgagctacaatctatgatatatattctgattggcgacaggagtcagctaaaccggattcagttgcgagctgtgaccaggcctggttcaactgaacaatggtaacgccgcttacaagaaaaactttcgcgcaatggagtattcgaagaatgctattatcgaccttcttatggaagatggcgtttttcttctctgcggttttctcggccacagttatcaggaaaatcaccgttttgatcacgacacaggcgaagggatcgtccgctgaaggccatttttggtgaatcgggcatgaagagaaaaatctttgaaacggtaatgcgcagcccaagatctcggatcatctgaggagaaatcacctcacctcttccgacaagcgtaagcggaaacaggacccgggggagttccctttacacaaaggtactgtgagattcatctttcaatcattgcaatcaagggttggattcgagcagagttacaagtaccttcaattattcaactccactggttcgtccttcctactttccagcccgtttgaagtaatgtccatgctggtcaaaatctggaaccagaaggtggaggtgttgagctgtgagaatttctccgtcaagttcttcaccatttggagttgagctgcgtttttgaacatgagagggctacaagtacagcactgtatgtacaccgaatcgacacaagagtctttaattaatagtacaagatgtctctgtaatacaactgtaggagtgttcttgccacaatagtaaatctgcttaataatcagatagttgtctctctctccaacagtgtttcatggcttctttttttcatcttctctaagcgtgggtttatcattcggtttttgttgttttttgttgttttttgttgttttttgttgtttcttttttctctcttttttaaatttatttacttattcattttccatatcaccgattaggactaggttttttccgaaaagttggacttgcccgaaacgagaggagagtcgttgcgtaactaagtatgaagtgtggccgggaaaacgcgaatcccgccgtttaacaatgctccaggtctcttgtcagtggtattctccgtctggatgacttgcaatcacgtgcctacgacgcgtcgtgcagctcacaagtaactcatatgctatacattttggcccatctgttttgctgcttttcaccaaccagctcaccaccagcttgccatcatgacgtccaaccgccgatctgtttcggatgtgctcggcggagtcaagcaagagaccacaacgaagcgactcaacgtggatcgcaacatcatcgagcgacgggttggaggcagcggcgggttgaccagaaacagaaacagaaacaccagccgggccacgtcgaaaaccaagaccgacgggaatatcagtgggtttttccagaaggttcgagaaaactcgcccttgaacggaccccagaaaaaaatagttggtttcggaaagaatagggtcaggcgtcaggccaactcggccgccaaagccaagcgcgaagtcggatcggatccggaggaagacgatgcactgaccaagaaggcgaagaaatgcgacatggcttcccacggtggtccaagatccaaaagagccaaattcgagcccaatctctccgacagtctctccgccgacaatgtctcggatgaagagctgtctggcttctccgatctggacgacaatgtggcgtcgacgctggcgaaaatcaagaaggcgcgcgaaaaacatgacgccgcgttggtgacggagacggagccggatttcttgcaaacatccagccaagaagaggaggacgacgaggaggactgggaggcaatcaaagcccggctcagtagagccccgacccgaagccagctcatccgacaacagagacaagaggaggacgacggcgaaaacgacattgagttcgtgcccgtgggatacgacgacgcttacaacctggatctgagagaacgaaaggtgcgacgacaggtgaatcagcacgcccagtcgcaaggctggccggttgtcactcgagaaggcatttcgcacaagattgcgacacgcttccaaaaaatctacaaagaaaacatcctgcctctactcaaagccggaggtggagacaaccacgttttctacaaggacatcacagactacttttctagtcccggagcaaggagagccgctaacaccacacagctcatgtatctgggcggtcgcagatacaccacgggctactattccgagctgtttgcacatgagttgaacaagcacatgaccaacagcggtcttgcacaggatttcgaacaccacgtccgaagtaacccggaattgcatagcatgatcattcgtccagggcttttgttccacttccagacggcaatctgtattcctgaaaccgtcattcggctgatcatggacgaccaaaaggtctcgtatgaagaggccgatcagatccggctgagaagtgctgagtttggagttgttgttgcggagcgaatccaggatgaggagcgtgttgagtctagtagtggtgaaggtgatagtgagagcgaaaatgagagcgaaaatgagagcgaaaatgagagtgagaatgagagcgagaatgagagcgaggaggattagcattgagctactatactgggctggactgagctggactcgattgtacttgtattatatttattgctacatttagtgattggagaagaccaacatttacataccacactagttgatggatttctgtactacactaacaacgacaaaaacatatcggagtcggattcgagatttacagaagagcgtatgagaatcagattcacaacgtccctcttattccggagtttttttgcatgttttttttttttttttttttccgagatacaagacgaaatctcaaaggttgcataattaaatgcttggattctgattgtcgacttccactaacccgattggagtccgggtgcgacctttttgctcctttcagtgtcggtatatcgcggacagttatatggcatactcttatatatatatacaggtccagactgacgccattggaatcgagtgtttgtattgtactacaattagctaccagtactgagactagttaaagatacattccacttatagatcacatcaattagatcagttagaccagttacaatcgaccaaaattctcaggacgagcgggcttgttgtcaaagatcttctcaatcttctccagaacctcatcggtcaccttgtcgagaatctcgtaggtctggaggttctcttccagctgctcgactcgagtggctcccagaatgacggtggaggtgtggggctgtttgaggagccaggccagagccaggttggcaggcttgaccccaagctcttccgacagctcgacaaacttggccaccttcttggcgttggccagaccgctgtcactctcgagctccttggtggctagtcgcttcagcatggggtcgttcttgatcttgtcgggcgagaaccgcgagtccttgggcacctccttgaggtacttgccggtgagaataccctgggcgagaggagaccagatggtggttccgtagttgtagtccttgagaacaggtcccagctccttttcgaagaagtctcgctccagcaggttgtagacgggctgctcggcaatggggggaatcagtccgtacttggtagcggcgtggttggctcgctcaatctcgtacgaggtccacatggacgtgccccagtagaaggccttgccgtcgttgatcacctgggtgaaggctctcaccacctcttcgatgggggtatatctgtcgggtcggtgggcaaagaccacgtcgacgtaatcgagttgcagacgcttgagcgactcgtcaatgccctccagcacatgctttcgagacagacccagcgcgttgaccgtcttggtgggaccccagaagagcttggtggagatgacgtactctgttcgcttccatccgaggtccttgatgatcttacccatggacgtctcggcctcgccggctcggtagacctcggccgtgtcgaagaagttgatgccggacttgaacgctttgtcgaaaatctcgagcgtcttcttgtcctccactccaccgtcgccgtagttgatccaggagccgagtgacagagacgacactcgcagaccggacgggccgagaaatcggtattcttgcttggggatgagcgacattttgtttggtaggcgattggcaattgagcgtttggattaattgagagtgtggggcaattgaacttcttgggggcaattgagtgcaatcgagtcgggttatataacttgtgtcggggtccgaaagccacagaagtgcctggtgtaaatgtaaaatgccccacaaggttgtgcatgacaaatgcgccaattactaatgtctacggagataagttaagataatgcagggtgggtgggtcgggttccactttgtgtgctaaaacaagacgtaatcgcttcatttactcacaattattatgtaatcgcttcatttgcccatgattattatgtaatcgctcctcttgggctctcagatattacgtaattgcccaattcgccgttccctcttcgcttatagttccccgccttacagtgtccatacatggatttagttttgttatattaaatggccaaactctccatttctcgcttgtaataataaaaataaaaataaaaaacaataaaaaattgaaaaaaaattgaaaaaaactcttcctctcacctcacaacaaatactcaaacccatttcgaccaccaccgttccgattgagccgccgcaaccacagaaaaacagcagtgctcagaaaacacgcgccaatcatgaaccccatatcgatccacccagcccggtgaaacacaggaatctccctgtgggtgtgcgttcgaaactcgagaacgccaaaccagttgacgatcatggcaaacacggtgaagctcatcagccggcggtttcgaccctgaacgttgctgcccagccagcaggcattggtcacaaaagcagacaccatgttgggcaacacaaaccacgcgcctccatacatgatccacagattgtgatccgacggctggcagaccactagggcccatccaatgatggcaaacacatagttggaaagcagaaagtagtagttgactttccacttgccgctgaaccacgcctgtaacagacaccacaccatgcacatgaacatgaccggccacactatcagctgtccctcggcgggcgagtacttgagatagccaaaggtgtaggtcatgaactggctgtagcacgacccgatcccgtacatggtgaacatgcccaggataccgcagccccacaccagcgggtctttgactgtcatcaccagtccctccaccagcgtctctgtgggttccacggggttgccgttggcgtaatctgcctcggtgtacgccttgaagtattggtaagccgccagtccgttctttcgaatccacctcgagctgtaaaagtactcgggcagtgtcaggaacaccagggaggactgcagacatcccgcggttccggtgatgatgaacatccattgccagccggcctttccgtcgtgaatgagccccagagcaatggcaatcatggcgaaacacgggaccaaaaaccacgacactccccaggcacacgccagaatgaactgcccattatatctgccgtggttctcgtaaaccacgtagagcatggcggggacgccaaagttgagcagcagacccagaaagagtctcgccatgatcatgccgccatagttgtggacaaaggcaaacaacagacagttgagcccccacagaaacatctctgagcccagaaagattcggggattgcaccgcttgaacagaaacacaaacacgagaggaagcacggcataggggaaatacaaacacgcaatggaccattcatatcgtctgggagccagccatttctggattccaaccgctcccgacgaaatcacatctcggcagatgatatgacttgcacaaaacgcctggagttgcaggccgacattgagactggttgcaaacctgagtttcttggcttgttgcggcgtgagcacgtctttctcactgatggggtccacagaggtcttttgcaagtcttcacccgaagccgactccaccaggtctccatcaccgcaagccaccgacttgtcaggagatgaggagtccatctggcttgttctgtcgggagcatatccgtactcacttgttctccccgatgagcagtctgcgttttctgtgttgattggagaagaagggttcgtcatcatgtgattggagttctatcgcaggactgagagagggcatgactgcttttaacgggttcgtcccgcccctcatttacgaactggccatctttttagtccccagtagtgtggagagagagtcttctgtggagtcagagttgcaagactgtgaatcgaacgaagcaaaagatgctgaaacgaaccgtcagtctcgagtccgtcgtttctatgccccgggctgattctagcaaagtccttcgctggatctcgtcacaatgactacaattccggaagtcagatgcccgggtatctcttgcggggtttatggtatggaatcagtaggcgactactgtggtgatagtatcgtgagccgttcgagtctttcttgatggggatacttgcagtgaaatcgagtgctatggatctacctgatggcggagattactcgtctcagtggtactctgactgacgtgatcggcattacgagatggcttggtccagatgaaccacgttcaagtggagcggtccacacaatcgcaagatcatgctcttggatgcacgataagaggagagtacactatcagtgcatgattagaccgattggtatttcggtgccaaaagcggtggagctagtgcggtctggaccttgacttcgcgtctgagcatctgtcccatgacactgctcctcggcacatctcagagaagagaaaaaccgccagtgttcatacaagtggtggttcttgttcgtcttcgccatccaactgcccaaaccgtgcccaaaccgtgcctatgagcagatggggttgagacatgggttaattacccgggaatgcggggggaagaacaagcagctcatgaaacggtctatagtagctactacttgtagtagttgatgtccaaagatggtaacgagggtcgtcaaagaggatgcaattggcgggggcatgggattttgaagtcacaaccctccaatccaaccaatccaacccccacaaaccaccggtcaacaaaacgtgcaacaggatacacgggttcttgctacaagtacaagtacaagatacacggtagcgccgcggcgggggaaacatgacagggctgtaccagctacaagtagcgttgtgacccccacagcgggaaaatgtctctagactgagccctgagccccgtgactacctacagtgacctagcacgagctagtgagggctggatggggcaagtggacagacattgatatcgtttgatccagactacttcagacgactccagaccactccagacgaagttcgattccccagatctgcaatttcaccaatgcggcgcaaaaatacaccaaatgtcaaggaaggaggagctcgcttgaggatcacgtgaccatcgtaatcccatatccccgttgttgtttttttgctgtattgtttgagcaagtaccctggtggttaaagagggtacagtatgtattgctgtaagatcaatctgatacaagtacatcatacgtatcattaccctatatcattatatcatttcttttgtgtccttttgtactaatagaaatctgtattctcgcgtgacagtgtctacaagaagtagtcgggggttcgtcgagacacggagggctctccgggacggggacaaggatcgtactgcaaaaaggagtttgagaggttttcgtccacctccatgatggcggcctggtttccgcatcggtagcagtagttgggggcggagaagatggtgaccacctgctgctcgtgtgcccagctgaagccttccatgaccagctggtgtgctcttgaaatgagactcaggttgtttgtgtggttaaactgttcggaaatgtcggcaccgaaggtgaagccggctcctcgggggctcattccccatcctcctcggtcatcggggtcggaccacagcaggtcgcacatggggccgtcgtggggcacctcctggaatcggttgagttctcggatgttgtcgatggactcgatcatgggagacaggcctccgtgcagacagaagatttggttctccaccagggcggtgacggggaagtagtcgaacagcgacgtgaaggctcgccacacgttggcgtttccgtactttcgcagacactcgtcgtagaagccgtagacctgggtgatttgtcgcgactcgtggtttcctcgcagaatggtcagtcggttggggtatcgcaccttcatggccaccagataggacaccgtttcgaccgagtagtagcctcggtccacgtagtctcccataaacaggtagtttgtgtctggacacggcccgccgattttgaacagctccatcaggtcgtggaactggccgtgcacgtctccacagatggtcaccggcgcgtgcacgggctgcacgttttcctccttctgcaacacccccttggccatgttgcacagctcgttgacgtcgtcttcgctgagaggctggcattcggtcagtcgtgcgatccaggcgtccagctggccgcgggttgtgggtgtcagttctgtgaacgtcccttcgcccccggctcccatggcgtccatgggcttgagtccgtcgtcgttgatatctctcatcagcacgtctgaatcttccattgtggcggttcttgtgggtctggtgatgcgtgaatgtgtgggtgtgtgtctgtgtctgtgagatggatgcgggtgacggaagctcttgtgtctacagcgagctcgagagatgtggttatggcggagtggtgtgtgtgggtcgacgtgtttacactgcgctgaccactgtgaactttgagggccgaaccttaatgttttcacccaatccctggctttttcgccggtgcgggctacctgaaaagcgagtcccggagcggttttatcgggaatacgagcccgccagcgtttttccttgaccccaaataaccaaattcgcccttttccccgccccgataccttgatttccccgttttggccgttcccccccatcccctctcgtactgccgctatctttaatggcgattattacgatacgccgcccaaaacttttttgaccgcggcagtctcctgataacggcaaaagacggtctgacggtgtctaataccgtcgcaaatcgaaccgacaaggctctggagccaggaaatggcgcttttcgccaccctcaatgtccaatagttggtcttgagggggttacccggttgtcgacagcaagctagattgctacaacctcgcgatcacgtggtaagcaagataatggttagtaagagaatggttagtaagatggttagtaagggtacagtaatagttaatcagtcgtgacaagagttggaatttccctggaatcaaaaaaccgaatagattggaccgtgtcagtttaatgagagtgaggtgatacagtacgtgtaagagtatagaactgtcaatggttgattgtacagtactgttgttacaagtgtatgttgctgtgttaaccgtttataaaatggcgaaaaatggaataaaagcggaaattgaaataaaagcggaaattggaagaaaaacggaaattggaagaaaagcagaaattggaagaaaaaacagaggataaatggtcgtataccacatatttgcctctttgtatttttatcttcttattattattttttaatatctttcgcctccttttcaaaattactcctttctgtctgaccccgccatttgaagttaccaccagactacgtacgagggattaactgtgccatgacgtaatagaaaggtataaatatgggttcgaatcccgtaatcgccctttgttggggaatgggtaaatgggtaatccattaggtgtgccgccgtatgtacttgtacttacgcagatatcgtgtttgtggtacgtttggtgtcgtcgaacagtgccgacgtggacacatggagtctggaagacattgttaaagaagaattgataacggactaagacggagctttttggccgaataaatcgatgcacaaacacggatccaatcatctacagagctggttggttgttgtaaagcgtttattgatgtatgtactggatatactggatatactgtacattcacttgtttgcccttttgatatgtgcatatatttatatatatatactgtatatatatactggatatacaagtacatactgtaacagtacatacagtacacttgtttgccctgttgaaatgtgcaatattgcaacgatacggtagctcctgaaatattagaaggcagcagttcccgagcgtccaaaaaccaccggatttacctcgacccctgcctcgatcatactgtgcattcttctccgcaatcgtagattgcagactggacaagagtagagctgctggactttgagatgaaacaaacacttgtggaatagctccatcaagtgtctcgtggtccatttcgcatctttcgcttcttttgcaactttccatcttgttctcgatacgtccagacaacccggcctcaccccatttccgatattgtagggttatcaatctcgccctcgagttggaaatcgatctgtatctgcaatgaggaaacattcagcgtacaatgaatgttcagggaagtccattgaaagtgcggtatggcagtattcggtacgcatgagtatgagtgagcacgagatatcaatgtagtgtccgatactaacaagatcaatccacttagacgaacagtgccagtaacagtagtttccgaaacagtgggcttcagagcttgccgaaaaccagtactcggtgactgattgatatagagccacaatgtagacggagatggccaaagaaacattcagaaaacgggtggactgctctaggactcacttgggcccacctaagacgttggaacagtgtacttgtagtattcttgctcccggctggggcagtgagtacttgtacaaacgagacgagtacggcgaagacctactataggtacaatactggcaccactgttgtttcttgttcagatcatctgagacaggagacatcaggaggtctaagaggtctaaacgagacctacaggagacctgaaacacctaatcacacctgaaacatctcaacaccaccacaatcacaccctaccagacccgaaacacattaataacacctcaaacacatccaatcacactcggtagctccctatgaatcttttaataatctctaagaataccatcctctgaccacggaggttcaaacacccaactctcccatccacacccactcttgtcaggggtggggggatgtgggggtacgcgaggccgctggggtgcggggggcgggggccgcgcggtgatgattagtaagcagtacacacgcgacaaacacacgtgcacgtgattaaatacacccacgtaattggacacgtgacgacttcagtgaccacccccttctccttactaacaaagttgcacggcgtgtgaaagttggagtgggtttttaatttaagcgtttcgtgacattgccagtttcgacacgttgaacgaacacgacgtgaaaaaaaacaaccccccgcctgaaaaaaacctgatcgcgaaaacaaccggaaaatgagagttgaacagctgtggaaacgcgactcggacgacgactcggatgacgacgataatacggtggtgcagggcccttccaccgacgacaacggagtgccctacaactacctgaccatcatcgacgccggctcctcggggtctcgagtgcacattttcaactggttgagctctcgagaggcttcgtcgggggcggaaaaaagacaagacacaaacgacaagaaccgaagcaaacaaaagggcgccaagggcggcgcggagctgcatctgctcaagatgctggaggtgaaacaagacccttcgtggtacaagaagattgatgggggcatggactcgtacgtcaaggacccgaccaaggtgggcaagaagcatctcaaaaagctgctgaaacacgccgccaaagccattccggacgaccagatcgcacgaacccccatctacgtgcatgccacgggcggaatgcgcaacctcggcaaacaggaccaactagctatcatcgacaacgtgtgtggatacatttcggacaagtccaacttctggctgcccgattgccgaactcacgtgcgagtcatcgagggcggagaagagggtctgtacggctggatcgccgccaactacctgatcggagctctggatgatccctcaaaccacgaccacggcaaggaccactccacctacggcatcctggacatgggaggagcgtccatggaggtggcattcgagcccgtcaaggggtcgggcgagggaggagctgccaccgacgatacctcctacactcttcatctggagggcaactacgacattcacacccagagcttccagggatacggcgtcaaaatggcccatctggcctacctgcaggccctggcgtcgcaaagtgcccaggagggtgacaaggacgtcaagatcgacgacccctgcgcccccaagggctaccgacgagacctcaagctcgccgacggcaccaaaatcgaaaccaccggatccggactggtcgaacagtgcgaaaagttcctcaaggtgctggcaaaggaccagtgtcgaacagccactgccaggtcacgtgatcttgacggcgaggagccgccgcggggctgtcttttggacaattcgcccctggacaatcttgacattcaccattttattggtgtttccaagtaccatgacattatcacttctcctgctcttggtcttgacgatggttccaagtacgaccatgacaagttcaagcatgctgtgaacgacttttgtgaagacgactgggacgatattgtcgaggagcatcacgatgtgtctgagaagcatctttccaatctgtgtttccggggaaagtggctggatgctgttctggaggagggctttggttttgtggggtcttctgagaagaacgaggacgaggacgaggacgagggcaacggtggccaagaggacgtcaaggaggacgccaaggaggttgaggaggctcccaagaagcctaagcgaccctctcggccaccctcggctattgtcgggtttgtaaaggggtctggtaacaagaagcccgaagacaaggaggatgataaggcggttgacgggaagaaggaagaggaagaggacaaggacgccgagggcaagaccaaactgtcgtcaatgtcccaggcttcggtatcgcacaacgacaagatggtgtacaattctctggacaagatcaacaatgtgatggtgcgagatactcttcttggaagagacacgacctatctcgatcccttccagtctgcggatctcatccagggccgtcagtactcttggcctctgggtcgggctgttctctacgcctctgccgagaaccaggaaatgaacattgtgggctacgaatacaaccacgaaaccgtgcctggaaaggtggagatcaacggagccgagcagaacgtggagtggaagcggcctcagtacaagcgaggagaggtacctaccgacaacaagacgggggacaaggaaggctcgtcggactggcacgagattatcgaggaccatggaggagaccgagtttgggggtcggtggcgttcctgttgattctggtgattgctgtctatctacttcttggtaagacccgacgccagctgattttccagtcggtgtcttctcgaatctggaagcgtcgaggcggtggacctgctcgaggcggagctcgacaaccctaccgaccgattgacgaggacattgagctcggtgatgtcgagaccgagttcgaggtgcattccgacgacgagcgactttgacattcataggtataagacatgtaaggatgggtttgttccattgtagggaggagagagggtgattagtgagatgagtacactcgtacatactccacgttcgggaacagacttagatcgaactgtatcgaaaggtcaattgtatcaaccatggaattggttgcacaccaagatctgcacaatcgggtgttagcgcgaaatctcaacgctcgtctttcgatggtttttgagtggcactggggtaggtatacctacccctttgtaaaaaatgtagtgaattttctgctgtttttgctccattgaaggacgagagatgtttccatcagaatttggacgactctcagaactgttggatgatcaggataggttatgattcttgtcgagtcacatggacattgataatcgcataatttacccataagacgagttttcgcggtatccatttggttgtttacttgtctatttgattgtttactcggagtactgtacatactataccactgtatactgcactcgaactatgacggttcgataaatgtcgcgaaaaataccacccagagtttctgaaaacatataatgcagttttagaacatctaataatcattgaccgtcttttccacgatctctggccttagattaaccaccaacatgacatcctccacatcggtgagaagtgagaaatcaacttaatgcactagtcaaactcccccacggactttggtgctgcccctgtcaacctcgccttcagactgcgaccctgtaggctaacgactctggggctgtagattcgaaaagtccaccaacatagaccatagtagtctcagacgagccgacatgtgcgacctgtgagacttctcgaatagcgatcgtcgcgattagcgtgatttcctccgacttgggtaccgtacctgaagtaggtacacccgttgagtgacggccattgaatacgaaaacaatggtggaggatgaaagactaggtactttcttgattatgtcgtacttgttggcgactagggagcgatcacaacggctccactgcacgagatgtcatctccggcttcgagatggaagggaactactcaggcgcatactctgaagaagatggggggtggtgattcggctcatgtaaaaactggtagctacaagtaaagtgtactccacagtatcgccatacgggtagctccggtaaacactcctaactggatcaagtcctctcgaaaactggtgggctcgactaagtacgtcaaaaatactgcacttgtacttactcacgcaagaaatataaccgatagatccgggtacactttacccagtctgtcaaacagattgctaggtcttggaagatgtggtcgtgactccattgagtctcttattattccctttgacaagggggcagaatagaccaaccatcttacaagactcgaatatcgctgtactgtagtcataattgggctattattactcatcttgtactcgtattcatagtgcaattagtcaccatctcaatatggagatgtacttctggcttttgcgtcgataatgcaggaccagaagagatgaaaactttagtgcgagagagtactcgtataagcagaagcacaagccagaattcttctctccactcgtgttcaagtggtgctgtttcccgattgccttgccatcccacctcattttcactcactaacaaagatgggcgtcataggaactagctactatcagaagtaggactagtcatagaggggtggtattgtacctgaggagctgtgcgtgtgactgccgtattccgaggctgtcggtgtttcaaagtcggccagagtctcgcagggtgtgccccggaaaccccgtgtctactggcgaattacgtcttttgacacgacacaaccagtcagcttcactgcaacctgcagtcaccctctgcattccaaaagagaatattgatcgcatcgagacgaaacatgtatgtattggtcttggtgatggatgttggaggtatgccaggggaactggaagagagtagcaggaagatagagcccgaagatgagcagagttcgaagatgagcagagttcgaagaaggaatgttgttgaggaaatgggcgaggattaatgatgaaaagtgagaggcggtcgaagtattgccagtcagggtgttgccggtcagagtgttgccggtcagagtgttgccggtcagagtgttgccccccaaagacaacatgttgattattttcatgatgagaccatctattgacatgacccaaacccccttgtaacccatctctatgttcattacagcgctgcacatactgtaggtaatggttgtaagatcgatggataccgctggcgaggtgttgagagagatgattagtatagtcaagtgtatacgttacattcttgtcttgtgattaaccacttacaacccactccctgccctgtggatatcagatggtactgtacatgaataaaaccactgtcgagtgatttgtagtatcatccaatcatttgacaacaccagatgtacacagtatcatacattcaagagatcaaatccatcgctggtgaccagtcttcgtgtggccgataactagcaagccagcgagacatcagtggttcatatcacattagcatcagatgttcccattcatcaccttggtcatctcttgaccgtctattccacctatcttcgcatccatttctcccgaggccctgtcttggcactatctggcattagcctgcatccaagggtgcactcgggattgcagtagtgcgggctagttcggcgtctagtctactggtctcgaaagaagcagaatgggataggcgcgaccctggtcatccagctcgtttcgactgtactgtttaaagcccatttttgcgtagaattgcgccgcccgggggttctgttcgttgacgtcaaccagaaccgcagtatggcctttctgcctcgcctgttccaccactctttgtacgagctgagacccgattcccgacccgaagcattctggatccacaaacaacgcctccatgtgtgtctgggtgtctgtttccgaaacaagaacaaaggccttgatggtgccagagtcgtctctgtgcaatatgaagtcgtcctggtggaagaatcgactgaccgtcagctgttgatcgatctcatcgatctctgctgggctcagaaactcgtgagatgcttccaccgatcttctccatactctgtggatttgttcttcgggtgtcgtcatgaaaagaggaagaaggggtactgaagaagaaaagggctaataaaagaattaattgattgttcgtgatgaaaatggaggagttctggaagatggtggagagcatagattccaagttgggttggttagggcgagactgggagacgagggcgcgttgggagacatcaaggccatctcttgcgcgacattcagtcgaactagccattagtcttacattggagacaccaagaccctctcttgagcgacactcagtcgaacgagccatttggcctgacaagaagtgtgatctttgtggcaacaccaaaaactccagttagtcgcaattacgacttaatcggccatacagtgaatacgtccatctttaagggaaacttgatcacctgttgtgccaaaaaaaaaaaaaagggcgcttgactgcaatcggactgccctcgcggtcctcggattgctatcggactgccctcacggcccttgaggtgtcttccagatgtctgatacgttggatcggttggagcgttagctgagagtcatcatctttcaccttccgccatcacctcgtcacattgctggacgcatctggctaagtcaacagcaggaaatcacacgcaaaagtgttacagtactgtaccacggttcaattgcctccatactcaccaaccccatgatcgtgctgtccgcctgcatggttcacgcctatggtgcggagtccgaaaccgttgcattccgcataccaaccacagaacacgtttctgctcctggaatgtggcgccaggcgcgccggcacaaagaccgcccagcacgccccggacgggttacccccgactcaccctaggaccgactaaaaatagctcctctcgccaccgtcggtaacctgataaccccaagggtgatgggcgtcgcccccttccgggtctttaaccactgccagatgataagcttgaaggttagttggtgccgtgcacagaagctccgaagaaaaatcgaagaaaaatcgaagaaaaaaaagtaaaaaaaaaaatttaaaaaaaaattaagtggtggcaagtgtcggcaagtgtcagcaagtgtcagcaagtgtaccttagagaaagagtttaaagtcgggggtggtaaatggttatatattctgctgggctgtttgtgtcactgtcaaaaaaacgtctttatgtattttcgtcgaaatcgtacgttcatcttctgttctcaaaattacaaacgctttgtaccgaattctgtaataccttctgcgtcattcgttgcgaaggtattttaattagttccggctatgagagtagctagagctaaaatggagcaagggggagatggaaagatttttggagaaatggggaaaaaatggggaaatagaatgataaagcttatgtaatccttttatttttgtcgatttttccgttacctttttttggtgcttataaatccccggaccgctttctatccatctctggtgcttgccattccgctctcaccaccaaggtgcagaattagccaaaaggcaattgcaaactacaattttatttaatccgaaacacacattatatgcagccgtacgcgactcatctcttgcgacatttaacggtttccgctttactacgactacgattgtggccgcaactcctacgaccaactcttgtctactctctctccacctctctccacctctctccacctctctccacctctctccaccctcctcagttcgatccccagtgctacactacagtgctacactacagtgccacacacagtgcaacaaacagcaccccaatccgcgtgaatgatatcgctacttccagacctggaccatttgacgggcgacgagcaggcgtggtttctgacgtttgcgtcgtcggtggcctgcattctgggctgtctgattctctacgtggacagcgtcatctacgggttccgacgcctcaagggctggatcaccggagaacctgcgggcgaaacggaggatctgtggaactccaagggctttctgatcatctcgctgtcgctgtcaggcggcattctcatcttcaccgctctttacagactgtttccccaggcgctggtctacctggaacactcggagctgctgacgccccaacaaagcaactttctggttctggtcatgttcaccagcggcgtcattgtctgtgccggaatcaactacctggttcacgccgccacctccaaatcaatcgtccattgcgtgcacggagacgaacgaaaagatagcgccgtcaccgcaacctcctcctccagccacacccacactgaactaccaccaccacgtgcccacacccagacacgaacccacagtcacgtccatggtggacaccatcacgtgcatcaccaggattctcccctcacccacgcgacccacacacacgtgatccccgcgggagaaatgtccgaaagcacccccttgctccatgtggctcccagaaagcggtcgattctcgatctggcccatgaaaccatcaagggagcggctcctgtcggagagtgtcgaggatacacctgtggcgactgttgtgcgcccgaggatcaggtgatttgcgaccccgatccgtttgaagagccgtttgcttaccccggagaagaattccggttccaggacgaccatgctcacgttcaccatgatcgagaggacatagacgacattgatcctcttgacgaccaccatcatgatcacgaccatcacgatcacgatcatgacactgatctggaacaccaggtccatcaccatcatgtttccacccgacgttcgcatctgtactccattgcgcttcagacgggtctggccatcactctacacaagcttcccgagggcttcatcacctttgccacttctcacgcagacaaggagctcgggctcaacgtgtttctgtcgctggtggttcacaacttcaccgagggattcacgattgcatttcccttttacgcgtcgcttcggaaaaagtggcaggccgtgttgctggcgtccattctgggcggctgttcccaacctctgggagcagtggtggcctggctcatgttccggcaccagaacctgcatacggatgccaccgatattctgtatgggtcaattatgggcatgacgtgcgggtttctgtgcatcattgggctgcagatgtacggcaccgccattggttttggaggcacacaaaaggtgtgtcttaccagtgcgtttgccggtatgtttattgttggttcttgttatgccttgaccgcttagcaagcgagaagggactcatgtggaatgatctaaaggcttcggtcgcgcgtatcttcggcgtcgttcggacgttgttgcaacacagagggactgggacgccttattttgtcacttggtcccagattatgagttatgaaaagcgtgcacggcacgcatattattatatttaacaggtttggtgttatgaccagtatcgcacttcagtgccagttggcgtagtcgacaccgtagtgaagatggagaacagaggtgaaatgagatatgaggaagtcacgtgatgatttcccctgactgtacgtgaatgtacgtgacttcctgtgactttattctggctggttgtaaaactcgggatctaagccgcctcgagatactctgaaactatcttcaagtaaagaggtaacaatgtcgctgaaagatgaggaaaagaacgtttttgatccagaaattagctcagtagatagctggggctgtggagtatttagtcaaaatttgtaccgaatactctctaaagccaggtgatctggacgcgctctctgagtttcattgtctcagcccaacactagatcaatttttgagtgttgtagctgtggagttgaccattatattctccaggatgagacgaacccattaatatgttcagatctctctttctgtctttccaagtatgtttcaaccgggaattgaatccgacggttgtagattcgcacattgaacgaagggccgggggaagtggacattggagaatacttgtaagtacaatctttggggaattatcacatgagagaattaaactgtttgttttcaataccacttgttgaatttcgtccttttttggcaaaatatgccagttcaaggcgacagtgtctggacaaaccacctccccggacaggaacacacatcgacaggggcttaaaagagccaacaggaagatggagagttcaaaataagagaatatgggttgtatttgactcgtttacggactttcggagggagatgattctgtggatgagtctgtggatgattcagtctccaacttggacctaaagagtatagaacattccattcagttttgttgtgacattattgacaaataagtgggctggagggtcagttttgggactctttaggggtctctgtttgctctcttgtcacaattatatattttcaacgacattccgcgtaaaattccaaaccgatctgtccattctgaaggtcaagtatttctcaacaaattgattgtatgtataagtattcttaacaaattgactgtatgtcaacaagcagagtatgtacaatacagtatctacctacagtactacgctacagtcgcatggaatgacaacctacaagtacagtacgttattgcgaccgtatcaatccattttatcaccccagatgagctattttcacctttactcgcgtgttgagatcgctctacagaactcctcaattcacagcacgccaaaaatgcacgattatcgccgaaattggtaccattcgcaagctctcagacacccaaatattctccttttatccattttcctctggaaccgatattcgagatgttttcggaccttttttcccaggaatcaaaataaggttacatatgcgtataggtgcgattgagtcccagagcccatcacaccactccagaaaatggtcgacttggtcgttacgcaccggatccgggacgccatcgtcattttccagtccttctacacaaagtactcgcccgagagcgtggagaaggagtggaatttggcgcaggtggcgtgggagtttcccagccagcgcggagtcattcgacagacagaagagaagatgccggttggtggcggcaatgagaagttgggcgacaaggatgagtcgcatccgggtggcttgaaagagtcaccgcactactccccatcgctgtcaaaactgctacaattgtcgcccgaatcaccgtccatctcgcacgttgatctcatcaacctgtccaaggcgttgcagaagaaaatccgcggcaagttgcgactcaagccccgaaacggcgtctttgagggctctcgagccacccgcacccacgaatacggacccttcaatctcccctatcttctccacggcaccagcgtctactgcccgccgccaccagagaaaaagaagaagacgcgcgagtttctgcgcattctggagacccagaaacggctgctggaagaggccgactaccagcagctgctggtggacaaatcggcgccagaaattacgaccaggggcctcaatgaccatttggtgcactcgaccgacctcacagccccctccgtcagtcaacagaccaaagaactcaagcaccagatcaccacaatcttcaacattgccctgtcggtcgtctctgtctcgtacgccatctggtactggaccaagagctccgccggcatgggcgtgtctgcgcgggcgctgttggctatctggggaggcctgctgattctggtcgccgaagtggtagtctacggtcgctacgtgcgcaaaaccaccgaggcgcgggtcacggagcgcaaaaaaaaggaatcaaagcagattgtcagcacgtcggagtttcgggcggggaaagcaaccattgaattccagacagaaataccggaagacgagtgtctggataccgtcgacttcaccaagggcaaccatctcaacaccgttctgggcgctaccggagtgcaaacccagacccaagctgtcaacagaaacaagcccattttctagctcctaaacgccttgaaacaacccatggacgatagaccatctatatattagacatgtaatttataacacctgactgcacaagttgatacagtagtttggagatcgaaaggtcgaattaagacgattttaataaataataataataaatccatttgttttatcttactccgccgattcgattccggatcccgcgcttcggttatcaccatctttcaccatattttcaccatatttttaccacatttttaccacatttttaccatatttttaccatatttttaccatattttaccttacctctcttggtaccgagttccctgccataatcaaacaacaatacagagaaacaaaatacatcttccagtatatcgctcgaaatccccaaatgtacagagaattgccaacagaattgctaattgtacttcactaccccattttccgttggatcacgtgactttatctgcggttatcgggcttccgaacagggccgggcggctgaacggtcggctggggaaggtgtccgttttcggaggtcctgattcggaagtcggaaccttattttgacatattacacaaaagcattgaaaaataaaaaaataaaagttgaaaattgaaaaattgaaaaaaataaaaataaaaataaaaataaaaataaaaaaataaaaaacagcaaaacagaaaacagaaaaagtggggaatattgataagaggaggcccgtctcttgttcagataagcgatagagcggacgattatgaacagaggaagggagatagaaggacgggaggaaaaaagaagaaataaaaacggaacgagacgagacggaacgagacgagacggaacggaacggagaaaaaagaacgaatgaatgaacgaatgtacgaacgaaacgaacagtactcgtgtaattgttgaagagtcacaagttgttttgaaaatagctgattgtcttcgtcagtcagttgacgtcatcactccgttttcatcattcacccttcatcactcactcactctttatcactcactctttatcactcactctttatcactcactctttatcactcactctttatctctgatccatatcacctcacttttagagaacatcatcgtccgtgtcggttcatctgttcatatctagagctggtcatgtgattgtcatttagaccatgagtggtatctatgtactgtactgtacctactcataccctacccagtgtctccaaattgtctccgcggagttggtggagttggtggagtggacttttgagtcgatcaacgccatttgagtcgagttaatgaggcggacaagtccgtggattggattcgattgacatcactctgacatatgtcacttttggtgtcagagctgactacctataccaagtacagtacaatacacactatacctacaagtacagtagtccccgacttaccaatttctatacgacaagtacagtgggtcgatctattaccgtctcccgggatgagcttgccattggggctacccttgtggtcttgtatggcgctacaagtacttctaggacgtgtctgagcttacaaactattctttggcggtctggagtacccgctagtgtagcctagcacccccatacttccccatatttgtagaaggctcactttgggatcgcgaagtactaataatcagatgttttggtgccctatgctattcaccttggacccaggaaaaagtgaaaaacaccgtcgatagtacggactttgaccgttcttccctcaaaaaacagtctagtaggattgacacaggcggaagttacatttactgtagatggtgcctgttctctaagacttacaaagtcataaacagtcatttaattcattctttcagtgaaaaaaggtgaccatgatacagtacacccttcggtagctgacgtaatcacagtgaagttcgtacggagtcgttcctattgagtcgctattcatccgatagttcaatactcggaggcctgagtacaaataggagcagagagtctgctgaaagatatctctgttaagtatccggtcttgttggtttttttatttttattttttgggcctttaattgcccgagccgaagagaagtgcagtgtatggtatgtacttctccagtcttcaatcctccttctgccttgaggatgtcttttgacacacgtactgctggagagtcacgtgagaaatcacgagaagaatctggaaaagtcatgtgaggagtatggaaaagtcacgtgaaaagtactcacaaccccctgatgaaacgttccacaagggcaccagtgtgtagtatttatgtctgcaaggagggcctcgaggggggaaaggaatgttccaatggattctctggctcaattataacggtttgtttgtgattgagagtagatccggtgactggattctcgtttgtgagtgaattggatgagcttcgatttaatcgcgtagagagaatgactgaaagatgactgaaagatgactgaaagatgactgaaagatgactgaaatagtgacttttgacaacaaattactgcttcgacaatggatgactattttgggagatcaaatagtcacttcgacaaccgctttcactcttcactcttcactcttcactctttagtcttcaccccatttttgtgctgttatctcttctatattatcactcagatctccctcgaatcccactgatctcactctagtctcttctgatctttcaatccttcaatccccaatacgaccatcgcgagaccgccagaagaggatcagatttcacaactgaaccatcatacgccccatttcacattgtatcgtattctcgatcgattggtttgctacctgcactcgcaacgagtccaaggcggacactcaatttccgatataatagatatttgcttcgcaaattgcagtgtctgaaaacttgcatttagccaactagacggaaaaaagagaaaaaaaaaagagaaaacaaaactgacgatccgcaaacgcaaaacatgtcttgagcgttcgtgaaccatagctttgtaacggtttttccctttttctttttctttttcgtcagagtcgattattagtgtcgataaaagtagaagtacttaaaactacatacctgtgctcatacctgtgctcgaatgacatattgacataataatggtaaccgagtctttgttttgtgtcattttttcctgttttttactgtttttttcctgtttttctcatacaaattcaaccggatcacgtgcccggttgcagcaactccgcctggcaggtttttcgttggacatacatggtgttggatcaaaatcgaaccgactgcctccctcattctacacttgactccacgttcgatccgatgttttttttcgcaaaaacagttgcaacagtacatactctaccccgtatcgtacgctgaaatatatatcgctcagaaccgatgaagtctcacaatgaatcgaaacccgaatcgcagctttcaaagtgatcagccgataactccgtctttgttgctcttagcaaacaacagtatgcacttgaacgaccccgatgagacatccaacgcaagatgcaagacgaaacacaggatgggataaaaatgacgaaataaagacgtatgcgattgacgaaacgaatgacgctgatagatggagatccgatcgggcggctaaatcgtggttatctggcgtgtgtcggctaaaccgccgacttgggaacaatgagactgttgtagtacagcgtatactgtactcgtacttgtagcccatctgcactaacgcacaggagtctggtcacgtgaatcggtcttatcgttctgtcacgtggaatgtcgtcgtcatcacgtgaccgtctttggtgcagtctcaaccccgacttgtaggagctggattggaggggcatattgggtggagataggtatcagaatatttgagggtttgtttcaagtcgggaggtggaaactgctcgccaaagggcctacgagtacaagcacttgtacaaggtggctccggtgacatgaaagtggtacttgtattacttgtattaatcatttttggtccaattgattaataatttgtccaagcgagaatcgaactggaaatatcgggagtgaagaactgaactgagaaaaacgagaacaattcaacagaaccatttatgtattctgcaacattgtggacgctatagagatcagagcgcaaatcggcaaactccgttggactcagagtggccgcttttatgtgagaagtggttttgttccccttcttggaacgataatacccttttgtgagccgcttgttgcatctttttattttatgttattttattttatgtcactttactctcaccttcactcccaatcttccaaaaatgctccgatttcaaaacggaaacttccgataatctccccaacgccctccaaacacgttccactcctgaaaacgcgcccctgctcccctgctgacaaaccgccagcatccctgctttttctgtgctctttttgccgcgccacaacgccacattcgcctatcgttaataataaggtttgttgggagtaaagaccaccgcaaaaaaaaacacaaaaaaacaagacaaaagccgagggaccttttggagcatctgggggtcacgaaacaccctgaaaacacaacacatatctgccagtagctcacgtgacgattcgtgggctaattttttccagaactcgccagccccatccctcggtcgaaaccggaggttcggaactccgcctccgggccgcccggaccaatcaaaagagagttatcacgcgacaattgagacattgcttgagtcacaaaccttatgtaaacgttattatcccggcaattaaggtttggatctgagcattttaagcgaggaacagtcatcgaacagatatcgaaccattcagaataactagataattaataaataaatgaaagaaaagaaaagaaaagaaaagaaataaataaaaagaaatatataaaaatccccaaataaaatccccaaataaaatccaaataaaattcacataaaaataaatagataccaaaaaattcaaaatacaccaaaatatccaaagtacaccccctcaaaacacaccagaataccccccaaaccccaaaccccctttcctcatatcacaaagatcctcaagacccaaataataacctaaaaaaaactagaacccctcaaaacgaaccgtcacgtgatccctccctcccttctacccccgttgccccttccctctcccttctctttcacgtgcttctctgctgtattactaccaagacttttttcgacccaagtcaaaaaaaacaaccaacatggtgatgtactcaggtgttgtgcatcaactttattccggtagggtaactgtcggtggagtgcatgtgcatatttttgtgcagatggttaatgttgtttttttggaggtgtggaggttttttgatgcggaaatggaccaatgttctggggaatcaagttttgcacatttatcaacatgtaatggcctatctctggggctccggagaaggatttttacatccctttttctcgtcaagattttttcaacttaaaaacacgttttgtttttttgagtttaacacagagtgacaaacagaatttaaattaagttttagaattaggttacgtctaacctaagatattcacctcctttgtctgactccaatttaaatgccgacgagatgtggttatgacggaccggaggatcctcagaagccgacgggaaatgctcccgtgaccaataccgagagccccgaagatggatggaacaccggagaactcggaaggaccttcaaacagtaatttttgaaggtattgcgcccgttctgacctgcacgaaatcacgaccctgttgcccgcgcggctgaataaaaaacttagaaaacgagaaatcaataaaatcgggaaaagtcagcgtaaataaagatgtccaaaaccacactgcgcacaatctacaggcggctgggaaagtataaaaaaacgtgtttttgagaatctggaacgtgtcattcggccagagagaatttttgtagtatttatggcgggttagggacgacttctattatacatttgcgggcttctggatgctgcaacggtagtaatgaatatcgagtatcatagcacaatatttttatggctgttcagacgccgagacgacgagaatttcgtcgttgaattcgattctcatctgtacaaaatttaaactgaataaacttgaaatatacgatgaatggagaaatcacgaaaataaatcaccatacaataaaatactaaaatgaataaaaaaaagataaatcagcgaaaaatggtaaatcagagaaaaatacatgcactcccgccatcctccccacacctctgcatgtcgctacagtacgatccgaaccaaccaaataggactgatctaaaacgtgttcctgcactgggctgctttggggcattaggtatagtagaacaacgaaagaaaacaaaaaaaaaataaaaataaaggaaataaaaaataaaaataaaataacggtaaaaacaaacaaacgagacccacaactaataaaaaaactgttttcaaaaaaagctgataggacctcaacacttgtgattcctccatcgactaatactgtcaagccacacatcgatattaccactcccatcgtgtcaaagcccgttgtcctaatcccgttaccctaatccagataccctaatacaaccctaacccaaccctgaccctaatcggcgctgcctgacgataacctagataacaaaatgggctatttcaggaaactatccagggttagggtaaccaacaaccaatgagcattcgatccgtccgcacgtgacggttctatctgccaagaaagagacaactgcccagggcttggccagcggggacaagacgtataactccgaggttaggggataaaacgataaccgagggttggggattgggttagggaccagtgcaaataccctatgttctccccagcgcctggtttcgtcttgcccatcgggtccgtcggactcctaacacagccgcattcgccgttacgaactttggtgagcttaggggcaaactgtcagggttaggtcataaacaaggttttagagatagccttcttttgggtttgtaattaagttcacaaaacataaagttagactttcccaaggttgtgttttaaactagacttaaaaatgccgttgttgcgaaatacatggcaaaaatatccacccgccaagacgtggtcgtgtgacggcttttggcggaaccaacgagaccttcaggacaatttttcgagcgcgatattgatgggaattgacgagtaatcgatacatgacacctccagatccacattttggtttagttggcccgttttcgacaaacttctggggtcatctcctgcggtgcagtgcggtgcaagatagagatactaccttgaatttttgagtttgggaaatgcgaaactggcgggttttggagggcttttgtggcgagggaagtggttttgggggttgtgagggctcgaaactggaagaaatgggcgattttgacttccaacggttttatttgggctcttttggacgttttctgaagacaaacaaatgacaaaataaaaaaaataaaaaacaaaaaaaatggcggtcaaaaccgtctaaaaagtagggtcgtatcgatatgtgacgttgcagagtccagagggggttgtagagacgagataaaagggatatgagagccaaatggtgtttcttgggatagttgaagaggtctttctggcggaggaattcaattaaattaaattaaagtataaaaaaactaaataaataaaacaaataaaaatatttaaaaatgaaccggtgaagatacacaaataagagatacaccagaacatttagcagagcccagagaatccaagaacacctctcgatctcggataacgtgaatccacattgagttggttacatatttcgtaatagttcattcagaaaaaaaattgattctacattttaattttcccttattattttcataattttatacacatacaatcggaaatcattgtatatagcgcctcctaaatctcccaaaatctccctcacacaccaatcgggtcaattccaatgccaacaactgctatcaccaaacggcaccactacacagttgccgcctcgcaacacaaggttagagttcactttaggccagcaaaatctaaattctatccaaatctaaagccaaaccctattccaaacatataaccttgttgggtctcttttgacttaccctaaccctacaagtctgggcatttcgatctcatgccaatatataagaagcgacgggtgcccgtgttttgaaagacaaccatcttgtgaggcgattaacacactaaacgcgactaacgacgaaccgactaactccaatcacaaacacaaacagttacactcacacaaacattcacacaatcgcaaacacaatcgcaaacacccacacaaaaccagacacccccacttctgccaaaaacatgtctgagaaaaatggagtttcctccaactccaccacggctcgaacagtcaccaattctaccgctctagaagtgcctcctccttacgtgcaaaccattgagcaggtgaccaagcaggaaaatgccaacattcaccagggtctttccgactctgaggtcaaggaccgtctcgccaaggtgggccccaaccagctcgacgagggcgagggcatttcgctcatcaaggtcattgtcggccaggtggccaacgccatgattctggtgctcatcatttccatgtgcatttcgttcggaatccgagactggattgccggtggtgtcattgccggcgttctgggcattaacgtgctggttggagtcatccagcagtacaacgccgaaaagaccatggactctctccgatcgctgtcttctcccaccgctcgagtgattcgaaacggagaagataccactgtgccctccggcgacattgttcccggcgacctcgtggttgtcaaggtcggcgacaccattcccgccgacttccgaattatcgagcaggtcaactttgagaccgacgaggctctgctgaccggtgagtccctacccattgctaaagacgccgaaatcgttttcgacgatatcaacctgcctgtcggcgaccgaatcaacatggctttttcctcctccattgtttccaagggccgagccaagggaatcgtcacctccactggaatgaacaccgagatcggagtcattgcccagtcgctcaagggccaggaccgaggcttccgacccgtcaagcgagatgagtttggaaaagcccgaaagcgagactacatgggcgcctttttcggcacctgtggagacttcatccagaccttcctcggaaccaacgtcggaaccccgctgcagcgacgactggccaagctggctctctacctgtttggtatcgccgtgatcttcgccatcgtcgtcatggccgcccagaagtttgacgtgaaccgagaggtggccgtctacgccattgctaccgccctcgccatgatccccgcctccctcgttgttgttctcaccattaccatggccgttggaaccaaggtcatggtccgccgaaacgtcattgtccgaaagctcgactccctggaggctcttggagccgtcaacgacatttgctccgacaagactggaaccctgacccaaggaaagatgattgcccgaaaggtttggatcccctcggtcggaaccttcactgtggaacgatctgaggagcccttcaaccccgagcagggagtcaccgacctgctgccctgggaccccaagactgagtacgccaagcgacgagagactgacgacccccgtgccttcgacgacgtcatggtcgacgtgtcgcgacgaaacaccgatgagcagagtcccctgttccgaaactggatcgactgtgcctctctggccaacattgccgaggttttcactgacaacgagggcgcctggaaggccaccggtgaccccaccgaaatcgccatccaggtgtttgtttctcgactgggcaagtcccgagaggagctcatgaagcagcagggcctggtccacgttgccgagcaccccttcgattccactgtcaagcgaatgtccgccatctatgatgcccccgatcagtcccgagtcattttcaccaagggtgccgtcgagcgagtcctcgcttgtgtcaccacctggaccgaccccgtttctggcgacaccgccacctttgacgacacctgcgttgccgagattgagaagcagatggagactctggccaagcagggtctgcgagtgctggcttttgccacccgacccatggacgcctccgaggaccccaaggctcgtgccgatgtggagaaggatctccacttcctcggtctggttggaatctacgacccccctcgagctgagtctgcccccgccgtggccaagtgtcacgaggctggcatcaacgtccacatgctgactggagaccaccccggaaccgccaaggccattgcccaggaggtcggcatcatccccgtcaacctgtaccactacccccaggaggttgtcgacgtcatggtcatgactgccatgcagtttgacgctctgtccgacgaagagattgacgcgctccctgttctgcccctagttattgcccgatgtgcccccgccaccaaggtccgaatgattgacgctctgcaccgacgaaaccgattcaccgccatgaccggagacggtgtcaacgactcgccgtctctcaagaaggccgacgtcggtattgccatgggtattgccggctccgatgtggccaaggacgcctccgacattgtgctttctgacgataactttgcttcgattctcaacgctgtggaagagggccgacgaatggccgacaacatccagaagtttgtcctccatctgctggccggtaacgttggccaggcattcttcctgctgctcggtctcgttttccaggacgacaccggcttctccgttttccccctgtctcccgtcgaggttctgtggatcattatgatcacctccgccttccccgccatgggtctcggagtggaggctgcccagcccgatatcatgaccaagcccccccgtgaccccaaggagggtctcttcaactgggagctcatcaccgacatggtcatctatggtctctggctcgctgccatctgtatctcctcgtttgtcattgtcgtgtacgccgacggaaagggccagctcggagtggactgtaacaaggagttttccgagtcttgccactttgtctaccgagcccgagccctggcttttgtcgaaatgacctggatgttgctcgtgctcgcctgggaggtgattgacatgcgacgatccgtctttgccatgcaccctgactctgagactccctacacccaggtcttcaaggacctgtggtctaaccagttcctcttctggtccgtcattctcggcttcttcaccgtcttccccgttgtgtacattcccgtcatcaacgacaaggtcttcctgcacaagggcatttcctgggagtggggcgttgccgtcctcggtctcattctcttcgtcattggcgtcgagatgtacaagtgggccaagcgagttttcttccgacactatgagaagaagcagaagaagaaggccgtcatttccgactttgacgactccgaccccttcgccaagtttgcccagaccgtgtctcgatccaacaccatggagaagaaccccattgccattgtctgatctcctgattggaccgtcttctcgacgctaacgagatgatagataattgattgtttgcttgaaaaagaagtttgtagttgtaatgtagtgtagcgcagaagtatccacagtaggactatgagtagagtacgagttcagcacgaggactcgtactgtacgtagatagcacgactctacttgtagatgattgcacaggaacgtcagcaattgattcgagcacagtaaccaagcaccgcagttgacctcgccagatgacaatggcctccgcagtgtgaaaatgtcgaatacgagccaacttcaagctcagaggtcacctgagggaccactccgtcacatacatcgactcagacttcatctgcaagccaaccagtatacagtgacgagtttgcggtcgaaccagaaagccaatccggcactcgttcgctttttgttccagctagctcatcgcccttgcatggggtaagcaggccaaaaaagctgcgtctttgtttggtggctggtggcgagaagttgttgaagtgaggaggcgaatgggagtaatcatcgggattttttaaccacagtatctttgtgtcccgctagcagtggggtgagtttacgtgcacagctccatatactgcaccatgttgagatgagaatggagaaagtggaagtgaggtaacgagtcaatgttctgggtagggtgtcacatcgatggtggtgacgtgttgttggtggtgtgcatggtgatgagaatctccaaggcactacgtgtgcgatgacaattgttcttcgttagtgtcgtgtcaatgtcgtttcagtatcagagcggaactttagtggtacgcttcccatcccaagagtcgtccaaatagtgtcccaaagaaaagaaaagggtcatcaggtcgagccccgaaagagtcatttcgtcgattccctggagtcaatcaggtagtgtgaattgaaaggactgttcgagtcgttctgtgcccagtgtcagggtcgatttcaggtcgacgtcaccatccttgctatttgagagtaaaccaaagaagaataccaagctccatgggagctgttgtcgtctggagatgtctgtgcagtcagtgtcagtaccccctctctgtctgggccagtggcagtgtctgtgtttagacaagccaggaaggagaggcccattctactcaccaccgcagctggtcggtgtgtgtctgtgtcgccgagagcatcgtttgtgtcactgagagcgtctttggtgtcactgaggactgtctgtgtcattcagaaagttgttctgtaccactgaactcccgtttgtgccacgcagaccccgtttgtgccactttgtgtcgttatagcgtcgtgtcaaagtggtgtgaaccaaaccaagagtgacagtcaccgacacttacaatcattatctaattcatcccattgtcgcttttccctctcaaaatgtatctatattaatataatttaatttttgtttccatctctcccaactccaccttatctgcattatctgattgtagtgctgaaaaaataaaaaataaaaccaataaaatcaataacgttctgaatcacaacgcaagcaaaaattaactatactaaaaaaatcaccaaaaaaattcgttcaaacagatatctctaaaatccttctccaataactcataacctgtgaaaatggtattgtcaaaatcatccactaaccaccactcatcggcaccaagaatcgtaccggtacgtagttgtccttccccacacttgccataatcgacttgacatccatttcgtcgtcagcgttacagcgcaaacaaaacgtgctactgtactctgttgtacctgtagtcgtggtttgcaactgcccaataattatccgcccaaacaaagacgcagtttcacagcagttgcgtatctattttctttgtcaaaaagcgccttgttgagagcacaagagatgggcattttcttttgttttgtttggttttttgttattttgttattttgttgtttagattttttttgttttttttgttgtttttgccattgttattttttgttagtcattttcagtcatttaatttaatttatatgatttacattgagttactcgtatataatcacatttatatttggattttctctacaacatagtcactacaagatagtcatttttattatatattttattatattttctaagaatttctaagaatttttaagaattttttctgtctttgtttatttctttgttgtattgtattattattttattatctgccaaaaaaacgtgctccttggctccgtaaaggtgggcacgtggagaaaacagattgtgagaaaaatgacatcaataaacataacagcgatctgaaaaaaacacaggatggtaaagtcgccttttaccgatgattggtctattgagaatgtccgtatctatccacaaaaacgagatattccccttcgtatgatcccaaagatagggtgacatattggtccacgacgataggacaacaagaccgacaaaagacaccaagtagctacccctgtgcaaagactgaccttgcggtgacactcagacgcaacccctctgtctgtcgtcgtattggactatttggcatgttttctgtagcgattcatgtcttgtatcagttgtctccaaagggatgctggaataatgagaaatataccgttggatttctggtcacgtggtgattccaatggtactaattttgagcgactgttggtgggtaagtatccaattttctcagaatggaggtatggggattttcgactcaggagaacaagagtagtagaatgataatatcctacacattccaacagttaccaatcactatgaattggagaaaggagtccgagaacatttgtctatattctgctgataatcgctggagaattgttagagaattgctagagaattgctggagaatcgctatactaaactccaactaaactccaactaaggccaacattatgcctacaaagtccaacaataaaaaattgaaatacagaacaaaaattgaaagtaaaggtcaattgaatttgaccaaagacgaattatggggccgaatcttgcaccattatctacgcaggatcgccctctacaaatgtatctactttttgtgtccaaacctctctataacgaacatatatggacatttctgattcacaggagggaccagtgtcagtctcatagtacagtattgtacagtactgtacccgagtgagcaatgaaagcacaaatttacaacgtctagtgtctctagcaatggtattgttaaatccttcggcgtctctgatcttttgagggtacttttctagggtcccatcccatatctggccgtaaaattcagagagatgtaccgaaaatgaccaaaaaagatccggaaaagagcaaaaaggcttgaagatgtgttttagtcatggtgtagtactcatggatccctttccgccttaaaaaatcttgtttttgctctgttgagatgagtctcggtatgcagttgtggaagatgtcatagacgggggttattgtggtggtagcaggtcgtaatgacacaaaagcatgtagataagtagagctagctgtggcgaacatttctatataaaaattgtcaaattgcgtgctgtggtttcgtgttgtcatgaaggatttccttctgatttgaaatgaacaaggatcatctaaatgtcaagtaatctgactccatgtcaagtaaagctaactacaagtcaacccaagcaaaccatacacaagtccagtaaatgtcaagtagtgccgactaaaattccactaaacgtcaaccaaacctatctgaattatatcacaaatccctttcgcccaaaaatcgtgttgtggcggttggtaatttgaatttgtaccacaaaagacccccactgacgaccatattagtatcaaaatcccaactaaaattctaactaaaatcccacctaaaatcccaactaaaatcccaactaaaatcccaactaaaaccccaaccaaattacgcaattaaagttcaacactgcatcaccatctgtgccgcaatttccctcaactagttacacaaacacaacacgatgctcagagcgctcaaaacacgccaattggcgccgatttttcgccagcgagtagtcacacgtctgctgacgaccgcgccggcggcaaaattgtcctatgtattcgatatcgacggcgttttgatgcacggaggcgaggcgattccgcagggtcgccaggcgctgctggagctcgaacaggcccaggtgccgtggattctgctgactaacggcggcggcaagtccgaggtgcagcgaacggaggagctctccaaggcgctggacttctacatagacccgcagcagattgtacagtcacacacgccgttcaggggcctgtcgggccaatatgaacgggttctggtggtgggcggagaccacgacatgtcgcgacaggtggcagaactgtacgggttcaaacacgtgattgtgccggcggacattgtgcgagccaccccgcacgtgtggccgtaccaccggctcacggaaaaggacgacttctgggtgctccccaagaaagaatgcgaccagctggtggaccccaacagtggcatgaacaaggtggacgcggtattcatcttcaacgacccccgagactggggcaccgacgtccagatcgtcatggacatgctactgtctcaagacggacacattggtaccaaggccaactggcacccgcgaccatcggagcccaccctcaagtcgccctccatccccatctacttctccaacaacgacctgctgtgggccaaccagtacccgctgcctcgtcttggccagggagctctccgaacaaccatcgaggcgctgttcacagaactcaccggctacaaactgcgttccaccatcattggaaaacccgtgcgggaaacctacgagtttgccgaggagacgctcgacgactggcgacaaaagaccttcaacctggcgccggggtcgtgggaaaaagtgtacatggtgggagacaatcctgccagtgacattgatggagctaaccgatacggctgggagagtatgctggtgagaacgggcgttttccgtgacgccgatctgcccgatgcggtggccaaacccaacgccggtatctacgataacgtcttggatgctgttagagcaggcattaagagacattattagataccacattgcgtgatgctgcgcacgacaacacatggtgagcgtgatgatgtgtctctatagtcgcacacaagaatgaatggaccttccttgccttgcttgacccactacgtcctccctcccatattagaaccattagatagtgtttcaatacattagaatgacatcacccgcgtagagagaggaatatccaaagtacgagctcgtagattctctatcagctcccggggttatcctggttggtactctcgggtcgattacaagacctgaacctcacgcggggctctcgagctgtcgttgggcccatctcaagatccacagcacccagctgagactcgttgccctcattattgttgcgggataacgactataccggagggtctgatgagagaggtggtttgtcatgtgaacgatagctggaggacgtaaacgatagatgagtggttgtttgagcgaccagtggaggcggacatatagcgcatactgtagggtgctttacacaagtgctttgagacaggatatatgaccatcgccacttgtcttcgctaggtcgagagccacaagcccctcaaccgtgataccatactaactgatccacatgtgatccgctttcgcctcttgttagccctccatagaagagctacaagtaacaagtgcattgtcaattacgctcttttgtcgcacggtttgatacccgtcacatgtctgatattgtgtatgaagtttggggtggctcatcgcctctccctgttcccctgttgttttcccttgatatttccggcatttacttgacattagttaacaaaccttatttctaacggggcttttactccatcactaagcaatcattagccaaatcttacgctgcagtgaaacatctggtagtcttctcatattctatagagtttagtattatgatgttataaaacaaaatcaataccattgattacataagaaaaacacttccaaaaaacaccgcttactaagcatgacgtcatactagcatgtactctccatcactactacaatgtcttgttgaagtatgtgtcgttatgggtttgacgttcagtattaccatcatattttcgatcgatctatgtctcagttcagttcagtattcggttcgagacactaaataatttacgatggtcctttttttttttttttttttttgcaagattttagagcaagtttagtcgtggatattagataagagtcttggattggaaaaatatttgtttgggaatatcagtttccttttttacctcccgttttttccatttctcccgcttttttttcagttctcccgggtttttttttccttcttttttttatatattttccatttcttctgtaggtctccaatcaacacatggtcttttcacatactcgatcctgccgggtaacatgtagcaacggttttgcgtcggaaaaaagccgatcgtcatgatcttctatcacaggcagcattgcatctgtacggatgactgatagtagcggatgttggcttttctatttgatatttttatcttattttattttattttattttattttatatcatttttttccgtgttttgccccataattattccacacattgttttcttgcgcgcaaatgccatattttccacacacatttttttcctatgacactgctccaattttatggagataataaataattaaataaaatcaacaaaaatatttggaaaatcaacagccattccatcttcgatatcatcacgtgacggatataaaaacctcagtttcgctaattctgtaatttcacatttttctatttctatttctatgtattttttcgttgaccgatttaattagtatgatcatgtgtgccccacctttcccctcctgatcaacgttgcttttaaccgtggcggcggtttttttctcttaatctttctttctttgctgtgtcaaataaggtttagggaggggcacaggatacaagtggcctccctccaggtgatacgtcaccacatagattgggcaatctgaagtgtggcatgtggcagtggaaaaaggtggcagtggcactacagattgtggtcatatctcattataatacagggcaacggatggttgcatgctatgtgtaggtccggattgcggggtatcactggcaaaacggaggaggttagaccttgttggcctgggtctgctcgcggtggagcttggatgcattctgctcgtgcagctggtccttacaggactggaggcccgagcagttgtgctgctccagcagtcggtgcgtgctgcaaaacttgccgtcacagaaggagcagtcgccgaccatgcgcaggggtgcgctggagcagccgttgaaggagcatcgcttcttcttcttggtggttttgggggccgagttgcggctggccacgttgcggctgaccacgttgacggttttggagtcgaggtcgagctcctcgatggtctttgtgtcgtccagcgactgtccgccaaacaccaggtcgatggtggaggaggacagggtggtgtcgcgctcgtggaggtactccttgacggcggcgatggtgttggaggcgtccatggttacgtcgtacgactttccggacacaaacttgacagtgaagggcatggtagggatggcgtggtggggttgggtgtggttgtaggtgtggggagtaggactattctatgactgatgtctcgatgtctgtatctctatttctctcgatggctgcgttactacggtggcaaggcagggacagtacggaaacgaggggtgctggttgagtctctcggtgtctctggttgagtctctcggtgtgtctgtttgtgtctgtgggtttcggctttatcacgctatcaaattaatggggcgtggagttgcgcgacttgggtggcgggtggcgtttgggcggcaaaggggcacacagatacgttgggtgtgtggtggtgaggtgtgaaaggtggagtgcggacccgccccctttatatacaaagccacgcgataacgtaatataatgactctgattgccaaacaagctcgctatctcttctcggaacttccataagccttttgtctgccatgctaaaaacagcacaaagtgtaccatgcgcatgcaaaccttgagtttatttctggagtttaaaattgccccaccgagctgatgctgatgatgactgattggttgccggttcgtcggttcgaaccgtgcgaacgcgattaacgagttggaaactggacatttagtagaagggttggaggggttggaagggggtgataaggacgatgcgagggcgagaaggacgccacgagggcaaggaggacgctggaaggacgttatgagggtgaaaaatggtcccaagaggctcaaacggagcagcggggtactcctacgagtagacgacctacaggcctactcctactcctactcgtacgtgtaaagatcggtaatacatccagtttttgtaatatgacccaaagtagttccagtcatcaaccaccttctccctcagaaggactgatccacacccttgaccttgcccttgcccgacctacttgtagccgctcgctcaaagcaataaaaactcagcagtcagtcataatacgtaacgtcatgtgacgctcgagggagatacgactcgtacaactgtacatacaactgtgcaactatctctacccatacgttaactccgaagtccgaaattaactccgaaaccccatagcggtcacttgacgggcataaaacaggacctagcgactgctccagaggtcctaaaagtcccccgaagcccggaatctgctcggacgaccccgcagaacccacatctgccgcgaaagcggtcccgaacggcaccaaacggccccaaaccctcgccacgccccatcggcttttttagcccttctttccgaactcctttttttcccgcagccccaaaaaactcaacatggtggtttcgagacatttcgaggcgcagagaaagactgaaaaaccgcgcttgtgaaccctcgtttgtttcaatccggcaagtccaagttcgtccagtcggaagaccttgtcgggagaccccacccgagtttcacatggataatttaaatgattaaaaatgtttttaaaatcattaaaagtggcaaaatgatttttaaaaaactgaaaaaagaagaaaaaggggggaggggaaacaccagataccaccaaagaccacagcaggcatcagttgtacagaagccacatgagaacatgaatataatctgtcttttttttttcctaccgccccttctcccttttccctcgtttttcctaattttttttaattttttttaattttttttttaattctaaacatgttcgtattgctccatgtcttaaagttgtggcaccaaaaaaacgacatcagaaaaggtgggcagagccgtggaagggagccttgcggacgccaccagtcacgtgattcaaatactgactggacgaaatcccgagccgagccgggtcgggtatgtcggtcacgtgacacacaatctacggcaggggtttttttttgtttttttctgctcggatagtcggctttatatccgaaaaaccacaaaccgaaatagtccgagttcgaacttgtgtgggaatatttttccgaaatgaccaaggctcgatcccttgtgtttttttttttttttgttttttaaacagaacgtactcgtactcgtaccataccgtacataccgtacaatatgatattgccactcttacgctcttatcatcaggcacttcaaaaactcgtatctaactaacacctccgatctcgctcccggtctcaacagaatcgaacccagcaacagtgtctcaccaacagtgtctcaccaacacggtacgagacatgtcttcggtgctggagcggttttcagttgcgcaaaagtgagacagagcggctgtcgtttggcgtttaggccgtaagattgttgatactctggaaatctctcggtgaaggccatggaagtatggcagtatgagtaatacgaggaaagagtacgaaacgagctacaattaccggtagagataccatacaatccaataacggaagccccagggatcattctgacgtttgaaaagcgtcgcctatcttctatttgggtggcaaactccagaagtaggaatatgtgaaactgggaggtgataaataaaataaaataaataaaataaaaaataaatataacataaaaaaataaaaaataaataaaaaaggtgtaaaagtatatactatagttcttgtactcgtgatttattgtagatgactcaaccatggcgtagactcatactacaacacgtgcattcaaccattccaccagtttcggtttcatcacccttctagaaacttccacacaactccacggtcacattagtaagcaattaaaaagtccctctagagctacgggacctctctctgggcaatgcaatcatttccccacattactctgtttccccgcatggcccaaaatcgcccgaaatccgcgtttcgcgcattttcgcaaatacgacgattccagactcttctcgcggcttccccaaatttccgccaggttcagataaccttatttcagtggcgagtgcatgattttgcatataatatgcatataatatgcacccgtccagaacttctggatgattctcgtcaggtggcaatggtgtatatagggtggggatttcgccgtctctgtcaaccaacacaatcacacatcctcacaaacaagacaagaaacaatgcaatttgtctattcgccctatgactacgagcagcagctgcagcagtatcagcagtaccaataccagcagcagcttgctcagcgacgagctcttgaggagtattatcagcgccagttgatgcaggagcgactccgacaggaggagcagaagcgactggaggaacagaagcgccaggaagagctccatcagaagctcattgagcagaagcgacaggagcaactccaggcccagcagttccgacaagaacaggcccagcagctgtttgactacatgtacatgcagcagttgcagcaacaggagtctgttcgacgacagcgggagcagcagaagaagcagatccagcagtctgctgccaaggccgcctctctggaaaaggtccgtgtggccgaagccaagcgacaggctgctcttcaggctgcccaggaggccgacgctgctcgacaagccgctctcgaagagattgccgagcacgagagattggaagaggagaagcgccaggaggaaaagcgccaggaggaaaagcgccaggaggaaaagcgccaggctgaggctgaggccaaacttgcagctgaaaaggcttccgaggagaagcgaaaggctgaggctgaggcaaaacttgccgccgagaaggcttgtgaggagaagcgacaagctgagactgagaaggccaaacttgctcagaaatcgctttcccactccgctcccaagcccgtgcaatccgaagccgaggcgttcgctgactactactcgcagctcacaggctgtcctggaaacggcccttcttttgctcaggctctcaaacagctcggagtcaatgttcattatcgatccgacgatgaagatgaaaccgagactctggccgatgacaaggagcgacctttgcaggttgatctttcggagcccgccacaaaaaccgagtctgagtctgcgcccgagcctgtttccgaatctaccgatgttgatgacgactcgaacctcaaggagcctaccgaagaaatccatcccctggtggcgttcctgcagtctctaggcatccccgctaccatttcagagccccagattgccaaggccgagactcagaccgaccctgatcttgctctggcagactttgtcgagtctctgagcgacgatgagcgaccttctgaggcttcaaagaaggccaccaaggccgctaagcgagccgcaaaggcccaggaggctgccctcaaggcccaggccgaagccgaggccgccgccagagcccagatcgaagccgaacaagagctgaagcgggaaaagctggagaagaagaagttggagaagaagaaaaaggcggcaaagaaggccaagactcagtctcctccctccaattctatcccctccaccccctcaactccccctaaacccctcccttcagtcgtggtctactcgtctcctgtcgataccgaaaaagacgtgtccaaacagctggccaaactgggctccgtggtcgatcgatcggtcgagacttacgagcgaatcaaaaaggccgccacccagtccgactccgagtactctaactccgtgtcttcttacacgtcgcgaatcaaggtaattcagcaggcccagatcaaacttgaacagatctacgaccagctggactccatggccgtgaccaacgccgacgaaaagaaggaacgaacccgacttatccgaaaggccgtctccaccgccgaagccatcgactctgtggtcgagcagctcaagtcggaaaagtccaagattgaaaagtccgtgtcttcgtccgacgaagaggagatccctcgaaaggtcaccaacaagaccaacaagatcatcaagaagaacaagaccgtcaacaacggctctcccgttcgaaaggtcaccctggaaaccgttccggatgccgactctgcctctgattaagcacaagagtcacatcttcttatttatgattggttgtataatagttaatggtattttatgatatttgacgataattgctttggtgtactgttttgttgtagttgttgttgttgttgaaatgaatctcacgtacaaaggtgcatttgctgagttcttatgggctcaaagccccacgcgcagattctcaaggtccctgagttggtatcgctgcttggaagttggggaatcgaaagtgtagaattcagcatagaatacattgtgtgagttgtttgcaccaccgaattcgcctgacaattgggcatgtatcaccgatatcaccgaatttatctcatgtggtgtgtcgtcatgtggtatcttccaaaaacggagctgtatccacaatatcgagtgacataatcgacatgacgatggacacttcaccttggaggtgagttgggaatgacatggtcacgtggcaaatcatatggtcacgtgacgaaaaactcctctggagccttctatcgtccttaatgtgggtgtgggttggttgatgagaggatcgtggagagaaataaaatttaaaataaaaaattacaggtgtttttttaaatgacttttttcctcccaatttttagttaagaatgggagttgcattttacttggaaattactggaaattacttagaaaagcctgcagcgggtaaaaaaacaattaaatgcagaaaaaaaattaaaaattaaaaaaaaaaaaaccgctcctctcacattcactacaacagcagacctcattgaatggccacaaaagacgcaagaataacatttggactggatcttcgcttttttcttttgaaaccgttcgttctaattcattaccactgcctcgcttactaaccggttctcataaccactaccaacggaacccgaagaaacgaacgacaataaaacagcaaagaaagaccaattccattgaaagcacccactttgagccgcttaagcagccattcaaacccacgaaatcaatccaattaatccatgccatgccgttgtattcgaagtcatgccattgtattagaagccataccattgtatcccaagcaccatttgtaccgattctacggattttacagatcgtaaactactctgagaaagctcgtaaactactcgggaaagctcatactctggaaagctcacaagtccatcggctcgcaatagaccatccgaaatgatgggatcactgcgccattgcatcgtgtgtatcttttagtctatgactgtgacgcccgtgcaacgagcaatagtcgttaatgtcacagatgtggcaaagatcattcatgtcattcatgtcaatgtttcagaatcaggatctgagatccaaaaatgtaccagtacccgtgggtactcggtactccggtagtgtcggagagaaggaatctatcagtattttgttgtccaaaagtgtcgctgctgaacagtatgtgtacagtactcgtgctgtactgaacacaggtggtagccatgtagccaagtcattgatcatgagttcaactgatgggagcagaacaatttcgcgtcagtcgactcgcgccaatctcgcaccaccaactcacacgcagtcactccactcactccaacttgctcgcgcgatcctttgcaatatcacacatggcgttaaacgcctcctgcctctcctttttcacgtctcctctgttgatccgctccaccatgttttccatgatgacctcccgcgatcgtccgttgacaaaaacaacgtagatgaggcctggaaacgtttcttcgtactgcttgttgagtctctcgagccgcaggccctcctgtgccgacctggcctgcagcgatttctgctccgcctgagagtgcgacgagtccaccttctgtgcgcccagacgcgggtgagcgccgatgattctgttgatccgcggatccgtgtcgtcgcccgacttgagcagctccagcagctccgcccgcacccgctcaatcagctcgttgtagtcgtggcactgttggcggattgcgccccggatcacaagctgcttgagagtggcacacggctcaaacagatgatccagcagcagctcctggtcggcttcaggcagcgacggtaccgtttctatcgcaggtagcttgtacatgtcgtgggtagagagggaagaagaagagagggagttgcgatctctcgcttatcattgtcagtagagtttcggagatggccgatggaaaacgtacatacttgtacgagtacgggtaagatactgtagacgtcaatcactggaaatatatgaaccggtgttgttttgttatttttttgttattttttattttttgttgttattttatcgttgttattttatttacttaatcaatgttactattattttacttatactattatcattatttagattttattttagattttataggagtcatggtgaacagccgtactgtctgtcttccgtcttgttcctgtagaagtgctgcagccacagctactcgagaggcgcggttgacgctacagacatgaaccggagcgacccgctggcagacttgacaccgagctctccagccagctcgcgaaacggtgctgatgttggctctacagcctgcttggatcaatcgctggacgtggttgagccgtgacagactcttgtcacctgtagcaatgtggacctcttgaagcctcggtgtagataaacgctctgatctggtcgcagaaacgacattgactccaaaagactcatcttctgatgacttgttctaactcctccacattccccgactgtcccgccaaaagaggagccgtagttcaaggcccttacctagcccggagacatacggtcccacacataacttctgatatggataaataatgcatttttatgtctgtctagtaatacacgagcatatactgtactcgattttggtccatgctagtcttgctctactcctcgacttcagtctggtctgaaacattcggactacgtcctcatctttcctccaagtctacgcaagcgccgaaaaccccttcaaagtctccccaactcccgtatgatatccctcttcaatcttccacttttgaccctcgtccaacttctccaaaatggtgcaactatgcccgaccaccagcaagcccgggggacgcgagccaatggcctccaccgcctcgacgagatattgtagagtggttctggtgactctctggtcatggcaagaagctctttctatcacagcacaaggagtggacagatcccagccgggagtggcagaaatggcctccataagtcggtcaactcgatgcagagccatcagaaaaatgactgttcgcgacttgacaaactcgggaatcacaggcatggctccctttcgtccagtacccgtacagatgagcacctggtcagccacatctctgtgggtaggtggaatgtttgccgccagcggggcagatagagccgatgtgatgcccggaacaacctcgggcttgtatccgtggccggcaaaaaagatgtattcttctcctcctcgcccgtaaatgtacggatctccctgtttaagtcgaaccaccatttttccttgtttcaggccgtcgagaccgcgctccagaagctcagtctgggcggcctcggcatttccggggtactttttggcgataaacacctcggtggcccgcggaatgagatccagaaccgactccggcaccaacttatctgccaaaatcagatcagcactgttgatgcgctccagagcagcggaagtgagatactgagcagatcccggcccagatccaatcaatgcaatgtgggcttttgaagacgaggaagaagaatcaacaactgcgggagccgagtcatcttcctggccgttttgctgactctctttggcgtcggcttcttgagaactatgataagctctgttaagatcatcaatggaaacattggcgagctttcccagagggaaatactccaccagctggctcaaccatcgtagtcgttgttttttcttctggatgaacgtctccgagtcctccacaacaagcacattgagtcgcttctgctcggcgtcgtcatcctcctggccaatgtcctctgcctcaaacacatccttgagatcctcctcgtagattctctctcgcagcgaaccaatcttgttgcaaatctcgtccacgttggccggcagagccgccaccatttctcgtttgagacgattggccagtcggcagcccttgccggaggtggtgactccaaactgaaagtcgccgtcggcatacgacgccagaaacgtgaaagaacagtactcggggtgtcccgcaacgttgagaggaacccgtaaagacaaacactgtcgatacaatgaccccagatcaacctcctcatgctgatggaccccaaccacaagaacctgatccacaactccagacacctcgtcccggcccagcgacgtcacgtggcggaactggaagctctcgtccacgtgctcgactttccccgtcttcaccaggtccttcagggcttccggaagttgtgttcccacatagatgggttgggctccgcactccagagatcgttgtgcgcgcgaaaaggccagattcgactgtcctgtgatgatgtggcgatgtccgtcgattttctgagcggtgagtagttgcattttcttcccttttctctctcgccggcttttatgtgtctgtgtgtctgtgtttctgttggtgtgtgttttatgtcagtcgtaaatcattcagtgttatatcatttttcacgccccatttggactgcatgaaatatgcatcccactactcatcatatcacgtgaaatgtggcgagtatgcacctatccacataagcgacgtgaaatatgcaagccactaaaccgtaattgggaaatgaatggcaatcggggaaacttgattggctcgggataatcgtggacctgagtcactctgtggcgcaatttgggggggtttcaacgccacttttctcggtggaggcggaggcggacacggtagagccgggtcgtcttcatatcacgtgagggagatgcgagtatgtgtgaggttcgtcgatgtagggtaaccgacgaacgtaaagaagagatgaaaagcgagggggcttaactgatagcgggttgctcgtgtacacaggagcgtcgtagttgagggtcacagccctttcggaggagccaagagcttcctgttctaaaagtcaaagacacaaataaaacggggaaaacaagctgcattctaaactatagaaaactggtgattatatacacaaaccaaataaggtttgttgggaataatatgtcaccggagtaacgtaactacacaggctagggagatagcttacatatgggggtcgtagttgcagctgaatgtaggtggggtggatttagcgaatttacttggaatttacttggaatttacttggaatgtgctgtgtagtactcggaaccgacgacaacagatcgagagaaaagtaaatgcaacggaaaactcatcacgtggactctccaacccacgttactgtgcctcctgtcgcccgcggtggctccaaatgtggctctagctgtggcttgacactagcattcaaaatcagccacagagaagagttttatggctgaaagttggctgaaagttcagacaacatcaatccgagtggatgatgaagatgaacggtggctgaggagtgtcattgatttgcatcggttgtcattgggctgatctggaggatgtgtagtggagagcagggttcttgtacagataaaaagatgaaaacctgggattgcaatacttgaacaagaagtattagcagtggctgtattgtacgagtacagtatgtatctgtagtatctcagagctatcggctgagtcatcaaacagaaggagggtatggtcaaggcatggatcaaaaagtcaagtgtagagtaagtgctgtacagtatctacaagtagagcagacggttgaaatggggactataactctggttattcatccagaaggactctcgttgatatattcttgtctgatagtgaatcattgtactagttcttttactgtagacaattgtccagctcaattgcatgggttgaatgagaggaatataacatcactagtacaagtacaagtgtagcaaaaggttctgaaatcaaccattgagaaaacccgctagattggatcgttttcaggtactttttcttgtagtttacgtcttcctggagaagtttgaacgtcttctcttgtctctcttctcttgtctctggtttgttgaacctcccactacactttgagtaggtttgttgacaatgtagttgacatatttgacataaataagaaaaaaaccaaaaaaaaaaaaaagtgaaattgtacagttctgggattgataaaacaaaccattgacaaaacaaccgtgaataaacataccattagcaaagatcattgaacaaaccatgagaaatggattaaaactcttttcagtgttcctaggacttgtgcagcgccgttcaaagcgattctccaaagcctgacaccgccatttgctcagtctgatctgatatctcctcgatcctttttgctgctccgactagcccccgaaacgacgctaacgacgcatcgcatcgcggctagtcttggcagtgggtggggatggagagcgaattgagaggagacatgggacgaaaatgtggtgatatgagacccgaaaaccatcatctgaggttcgtatcgtatccatgcatctcttcattcatgtttggagaagtccttagaagctctctatggcacagtatggactggagagtctagtatcgacgttaaagtagacacaagaaccacctgaacagccattaaacccacagtagctccacagtagttcccggagagggcgaaccccgcaactaggatatgcaccagtactttttttgacgactttgacacattggggatcacggtgtcatgtcatgtggcatatcggtcgcacctttgtagcttccatctcatgtttgtagtgcggtattgtactctcttgtaggacggtactggatcttaatgggctcttaccgtacagtatgagcacgagcgagcgtgagtattagacctagaaagattgtccaatttgataatgacggtgataatgacggtgataatgacggtgataatgacggtgagaatgacgatgagaatgacggtgctagtgacggtgagaatgacggatagtgacggcgggttgctgatatatagtcagatctcagagtcagactctcttgtcgatctcgtcgtcgatcccaattcgacatgcaaaagataattgccaaaatgcccattttccagacccccaaaacacccctccgtccccgcccccacacattactaagcaccccaccttttcaataaagttgcattgcagtaggggctatttagcaatatggggaaatagttgaaccgagttgtgtacacaacggagatacaaaaagaccgagaaatcccacagacttggatctgtttgtgtaactccaattgatttcccggactcgaactgtttgtgtaacatcgattgcagacttgtctttcaatccgcctctcaactcattggtaattgccgccttccatccacaccaataatgtccaccattgacaacgactgcgtcatcagcatccacaagctgattgacgcctactgctcggacccgtcggtcattcccgggtttgtgatgaacgtggtcaaccgccggggcgagctgctggtcaactacgcggccggccaaatgggactcgacaaccccgcgcccatgaccaccgactcggtgttctggctggcgtcctgttcgaagctcattggagccatctgcgccatgcagcaggtggagaagggtctgattggcctggacgactccgacaagctggaggaaatctgccccgaactgaaagaagtcaaggtgatcaaaatggtcgacaaaaaacccactctggtggagaagaagaaccgaatcaccctgagaatgctgctcagtcacacggccggcttttcgtactcctttttccacccctggctcatcaaactattcccccatgtcgacgagctcgcgggagacaaacacgtgctggacaccgctctggttttcgagcccggcacagactggggctacggaaccagcatggactgggtcggcgtggtaattgagcgcctgcgaggcaaacctgtgtcgcagattgtccaggaagacattttcgagcctctgggaatcacagatatcgaaatgaagcccacccagagcatgcgagaccgactggtcaacctgcaccagaaagacgccgaaaacggaaccatgacccagcgagaacatgtatactctttggacgctgagtttgagtccttcggagcaggctactttgcaaagggtagcgagtacgtcaaactactggccatgctgctcaacaacggagtggggcccgacaccggcaagcaagtgctcagtgaaaagtctgtagacgacatgtttgccaaccagatcccccagtggcccaattacggccgacgagccactcccccgggcaagccagagtacaccaatgctctccccgagctataccctcaaggaaacgctcctcagggctggggtatttcgttcatgttgacaattgagcccaccgataccggccgcggacccaacactggctggtggagtggaatcatcaacacgttctggtgggtcgatagacaaaagggggttgcgggcctagcccagtcccagattctgccgtttggtgatgaggatgtcatggttctgtggaacaccattgaagccatgatttacaagagtctggttgaggacaagtccaagttgtaggcaatgtggatctgatatttgaatgaatgatgttgattttgaagaaaggggtgtcagaggagtagaagggaaaaaaagtattcaacaccactttttcaccctcttatgtccacaagccaccgctgcattcacgtgcggcaacctggccgagtggtctaaggcgccaggttcaggtgactgaatcaatatcctggtctcttcggaggcgagagttcgaatctctcggttgtcagctagtctcgagttctcgagctcttctttttttcttttgttgagccatttgctcgtctactgctggcatatgtcaggctcttgtctgtcatgtctccaaccagatcagagcttgcaggaaaacagatttgaagaacagatataacaactggtacgttcagtactgtaccgatggatttgtttgtatcaaaaaaacctgtagaatcagttcttccgtctgatccagttatagtggcgaccaaagtgtagtctggttcatactccagagacatcgattttcgatcaaccctgactaaccctgacttgatagacaactacatttcagaaaccagggcctgcaaacaagttgaacctggaattcggtttcggattggaaatctggctttcgctctggtttttttttcggttttttagaccagtacaagaccaaataattgtgcttctacaagtatatatttgtccttaaccaatcagaaagacgacagttcttagattctacggcttcgtttaccctgcttgtggccattcttcgagaaggatgattgtcactgatggtatggtagtgaagcggaagagttatatatattgacactgtaataccatgataccaatgaacgatgcgataccaaagaacgacaccatgacaccaaagaacgacatcatgacaccaaagaacgacaccaagaattaaaagcattagaatcaacagccgcttcataaaacaatgactcgcaatgtactcgtcacttgtctacacacacgacggctcaggacttgtctattgaaatttcaagacatttttttcaaatttttttccatttcaaattaaagtttcaaataaacattttataaaaaagatctgcactatatatacagtatagatgcacgcacggtctaccaaatctaccaaaaaaagatggacaaaaagttctgtttccaaaagggaaaagcgaataatggaacaaaggactgcggcaaagagagaatataaaattgcaaaaaaatgatatccgtgagattcgaactcacgcctccgaagagaccaggaaattcgttaaggtattagccttaacctggcgccttagaccgctcggccaggataccaatagtgatttcaaaaaagttcaaatcattgtgagcgtgaaaaggtgttaaaatacggcgaaaaaatgaatcattagaacaaaaaacggcgaaaaaaacggcgaaaacacgaagagattgaaatacaatggtcaatatactatttccttgttcagctccccacttacctggcctcactgtctttttcggttccatcctgggcttctacctgctcctgttctccaaaagctcgaggtactcggaagatcaagggtgaatacaagctgatggcaaatctacaggaccatgacgacaatgacaacgacgactactatattgaatctcagagtctgtgaagaaacaatcatacatcgaaacaatcatacatcgaaacaatcatacatctccactatcatgtcggaacaagtatgagtgataaaactacaagtactgtgctagtacgagtacgagtacgggtacagtatgataaagtgctatgctcgtatgtacgtgtaatatactcttcctacctcagatcatcatctacctgaccgatggagtccccaaacaaactaatgtctcagcggagcgtacattttggggtggcgatcgtcacttgcgaccaactgcaataagaagggcgatccctgaaatgaaactgaattgccaccaagtgatttacggttcggcatgttcaagagagccttggaaggtgaacagatcggccgtcacagcccctcaatcattgtgtccgggtgtccaagacagaacggggaggcgacagaacggcgaggctaccgacagactggtcctgttcggcacatccttcccgtacagtaaagaggtatctacaacacatctccaaactaagagctagggttttcggatccgcactaaacccaagcggagagagtaatagccattgggttggcggagagcaacagccattgggttggcggaaagtaacagcccgcgaagagcaacattgactagcgtcgattgtgagccttacctgcgacgctgagtcggtttggatcgagaccatcaatccgcagcatacggccgtgcgaaccagtcgacaggagccgctacagtgagaaatgggcggaggaacaactttgagcttcgcagagacaactctccaccgccattggtgtcttcttgcggctgaaccttttatcccgccggtgtgcttccacttttcgaactcgatgcagaatcggacatcgtattgtgaaccctcggagtctcaaagttatcagggccttggttatgtctgctcggagactgtgatcagtgacatcgagatgcggttgtaaagaaagacgcagctgctgataggagagcgaatagagagagcgaagagcagtgaacacggcacgatggcgtagccacttgctatttagcaggagtgaaggagacattggacaaaaggaatcaatagcggaagattagaattccgttgttgcagacaaacctcgtacttgtatcatctaccgatgaatgtctggtaacagcagggagagctccgaggcacgagtcggaggctaatctttctaggttccaagcaaaagccgctaaagatcagctcctatcgggatagatagataaagaggggccatggccgttttcccggtgaccaaatgtccgtcatcatctcctatcagggaacccacttggatcttccttacgcaccagcagaagagtcccatgatgatcatgatgatgatggtgatgatgatgggtcacccagccgtaacaccacagggctagatgctctttccaagacaacaatctccctttcccggtccgactcgcctctaccttcgtttgaacaagtgatgcacgaacagagatcactcatggtggattttacacccattgtcacagtgaagtacacgaagagcatgcgggtcaaaaagatgaccgcagctcttgttcgtcacatgatcgtgtcggagactaggactcaaacaaacgagactctggtccaatgggatctcttttcgggtcgatgcaagcctgtgaaagggcccatttctgaaatcgccagtcctgtatctatccagacttccacccacaagtacccacttcactgcactcttccagctgggcttcatgaaactgcttcccacaactccagcaagctgtggtacactctggagacccaggtgagctgccaaaagcggttacattcaaactgcggcctctttgactattgccaggagattgtcatagctcgagacagacagatgaacgaccaggctcttctccccgtcaatgtgtcgactccttggctcaaaaagctcagatttgttgtttcttacccccagaaagtcattgttttgaatgaagataccgagatccccgtcaagatcaccactacactgtttgagaagcccattcggctcaacaccgtcaacatctccgtgacccaaacctgcaattcaaacgccaacgatgcgcagaaaactagactcctcaccgtgaattccaaccgatacgcggattcagacgagctggagcacgacgaaatagaactccagcaagccagggaagaaggcttcgacgtgaagaaaaactttttcgattccatccatagaggcaatcttctcatccccggagccgaggagacagagctggattatacgctgaagttgaatgtccggatcatcgacaaattatccgcatcaacctctcgcactcaccctcttcacatagtgcacaagatacacgtgtcgctgcgcttctcacaactggatatgactgaccagcccaatcagaagacccgaaggtacgtggacctgtctctgtctgcccctttggtgttctccagaacgcggagatcgcagccagtggacgcttgtttgaacctcgtgccgttcgagtatgaagactttttgctgtgcgagtacccccggttaaagaatacaaacatggtcttcaaaaacgactacgcaaacgactctgctcctctctacgagtctctcccacccccagtttacgaggcgatcgactcaaaatgggaattcaaggcggataccagaggaaagactggatgtatgactccaggtggatgtgtggaccaaagtggaatgcgaaacacgacaggttggtggtttcgacgaaccatgtattagcagattatgcaaatggcgataaaggacttgccaacggttctagcacttgtcgaatgacgtcaaagtgtagagagctgacgtcatgatcgtttaatggatccagactccagcattgaagtcatgactccctttcagggcctctaagggctctgtcaagaagcagaagtttccgtccgtgaaatcaagcgagtgttgggccaatgaggtggaatgtctatcgtgacagctatatttgaagtccaactaaaacttttcgctccagcaggaaaacagcaaggagtcttatgatactaacagaaccagtatttacagcgacaatacatatataattgcaatacaatacatttacccttttgtacacgctcagaacatggcatccaggttcgagtcaattgcatactaagagatgtacttgtaggactggtcatatatactaggaaccgccctgaccgaaaaacacaggcaacctggccgagcggtctaaggcgccaggttaaggcaataccttgacaaatatcctggtctcttcggaggcgagagttcgaatctctcggttgtcattgctactgaggtagttctttttgcttctggcagacgacactgttatcgtctccaggtgagctacagtgcgtttttagatgtagtggcatgtctgtacagtatcggagtaataccatcttcagtcgttgagtactgtttcactattagcattgaagtcaattgtgagatactcgtagcaggttgcagaagtagatctttcagtccccaagttccggtgataggagacagacgacactactgtcaaacccgctgaagacttgacttcgacatggaaaatgtcacagattccaaacagaagtgagatctcatagactgataaccattcatgcttcggtccctccttatctatgttggcgagtcttatctgcattatctaggcattaaccgcgcttatcagcatattcgaggcatgattgcgcgagagtcaataacgatccgtggaggtgagtagaaactcaagagaacccccctagagttggttgcaaagtgacttgtagttggactgttccattagcgagactcattgtgaactcctctgccacggaaaaacttgtatgagtacaccatatagaacagtcttaggacatgagtgcctccccatcaccatgtccacactcaaaaaacaacattgacaccgggctacttgtacaacgactgactcggaggttcactctgaagagatcatgtttggaaagattgacaatctgactgacagctggtcagcctggtcttctttctagcttggattgaaattggagtgaagactgtcatgctcattctccaatgaaccaggttctatctaacatgattgccgcttcacgacagtcctcttaagcgacgacagccatttccaaacttcttcaagggagccaacgacaagtatgtactcaaatcccatcagatgcgtcagggaaacgctatcaatgttgtattcggatgtctgtgtaccatcgacgccgccaaccactgctctcttctccttgtcagtaggaggcaacatgactcctttgttcccggccagttgacctcggaaaaacactgtccatggccattgtagggtttgcaaggctgtacctcgtcttcgttctcattctactacagttccctcaaaccacgtcccatctgacaaagacacaatgaactacacctgtgtcgctacggtttttgttatactactttctgcttgccactttgacccttgatcctgtggttatagaagggcagatggtggcagtgagagactgaccatcaagtgacagtagtatgtaatgtaataaatgtggtatacatacattaattgtttaaatcgaatgcaaacgagagtagcctaccaggacatctggttggtacttgttcttattccagagtaccctaccaggacatctggttggtaccagcgacatctggacggaacttgttcttgagtaccctacccgtgacattgggtcggtacttgttattattccagagtacccaccagcgacatctggtcctagttcttattccagagtatcctcaatcacctccagctccgtggggctgtagatcttgtcactgacaccccagatctgagcaatattgtcttccgacaccgatcccaaacaccactccatctcggggttgtaagcaaatgcagatacgggagcggtgtgacctccatgcataaaaaacagctcgggcgacgcgtcttcagcatcgtcctgcgactgctcacagccaatggtgttcatgttccagatgatcactcgtcggtcctgtcctccagtggcgaggtactgtccatggaaaggatcaaactcgatgcctgtcacggcgccattgtgaccagacagagaatgcagccggtagccggtatttcgaatgtcgtagaggttgacggtggactcggacgaaccagcagcaaagagatactcggaatgaggagagaaagccagacagttgtaaggagtgggcttgtcacccgagggcggtcgggtcagtgtaccgccggctgtttcgggggctcgagtgtcgtacagagcaatgaatccttcttccagagcagctccaataatgtaggggaaggtcttgtggcactcaacatcattgacggaggaggtggtgatgttccaggtcgatttcttggactccaggttccacaaaatcacttttccatcctcgccgccggaaaccaatgcctcggggtctccagcacctcctcttcctacagaccacgccagaccaaaggcgttggttgtgtgctcctttagagtaacaggtgtctcatcgacgctgccggtgacagatctgacgaagatggtgccctcaccgttgatagatgccatcaaatccccacagctcttgatcttgttgggttctccgtcatgggaccactccttgactgtcttgaatcgcagatcagcaggccgtccattgggtccgagtttgcccaggtcgcccaagtcgagcggaatcgtgctctccatcagcacaatcttctccttttcctccttgtcctgcgaaaaggtgcccgccagcgcctggtgaacccccatgcccgcggcctcatcctctctgtaaccacaccaatcgaaggtcagagacggccacgtcatggtggtttcggaaacaaacgagtacatgtacggacagttcctcttccaggtctcgtactcggccccaatgtccggggtctctttttcgggggaagccattgtgaattgagtgatgttggtgattttagccacgcgcagcaactaatatatttacatcaacgcgtttttaaggttaggaggagagttgagagggcgtgtgttcgatttgcggtggtgttgttggagtgaaattattctagaaaatgtccaaaattggatttcagagaaacttttcaatttatcaggtgtttttgagtacaattaaacaaaaaaaaacccacttatctccccaatagtcgctttttgaagcgaccctttacccacccccagcgtcgtataattatcccgattgggaagggcggccgtagtggtggcaacctggagagggacgtttctgcctgacataattggctgaagaagagtacgatgaacgttgtgcgacatgtattttctagaataaaacataatcaaacaaaatcacgtttctcaggtttcgagagagcgccatacgcacttactatggcgattccacgagtggccaccccactggccgaaccgtaatatggaaaataaatatttcacgtaaaaaaaaaacgcgtaaagtgtaagcgacgtgttggctgcatggttcacgacagaaaacaaagcagttagttcaaaccgtcgcgtgccattatttatacagctctctgtgctctctctgtgctctgtgggctctgctctctgtgctctgtgttctctgagcactctgtccgggaaacggtagcaatagacagacagagactcgcgccagaccaggaagatgacgttgcaaaatgggttatacagagagtgagagcgggtggcctcccgaacatgaagacgtggccgacttgcaagtgggttgctctcatggctatggtcccatcggaaaaagatgattcagcaggttcctcaagcgcgccatggtgttctcaagtcgggtgtggaggcggtacgaatggacgacaaacggtcggttctatacccacattggacacgaaaagttcgccagtatcgcctactatgacgtttggaagatggaccagatgggcaacggtggagagtgactgtcatgctgaacagacaatgtttcagaggacaccgaaagccggaaagtggaataccgtggttgaggcggtttctgccggaggaaaaccatcccaccactggtcaccttcagagggtgcgatccagacaagagcactcgacagctccgtcgggggtggcatgtgaccgtgcaaaagaaggcttgattgattgacaactgaaattttcgacgtgaatagcgaccgtcgatgaagctgtcctcacgcctcccgaggatgagtctaccttgatctcggatgattctctggacgattcattgagtttcccgacatccgtgggcaagaaaaacccgttctctgccagccccggagcccagaaagcctgggaggagctttgtgcttcaaggaggacctctgatatcgagcttcgtgagtacctgtgggaatgtattctaagccgacttttacagagtcagggcttgaaaaatcaagagcacttcatgtagtcttgatgaaggggtcctaaagactagacggacggacgaggagagtgaaagtgaggttgaggtggcaccgcatgacaatctcctcttcgcagtcatctgatagatcttccccgccccagctccggcggccaacgacttccctaggcgacgcgggagatcttgtgctgcttccaccgaaactttcgaggctgggctagtgccaggagctgatacgagtacccctgtccagaaacgcccgagaggaagacctcgaaaacagtgagctgttcagatgtcgataggccgagaaagagaggacgtccgccgaagaatacgctacccgaggctccaccacactctacttgtgtaccagtcgtcgagaccttgggtaatgtgtctcgttgcagtggtcaatgacttctaggactccaaccagcacattaggtgggaacgcttgtgcaatgtggtgtgtaacctgggtggatatacttgatagtagttgtgtaataatcattgtgatttgaaccaactactttatgaacatccatactttccttcataatacaaatcaggacaagccttgtcaaccagataactgaaagacctttgcgtgaagacttgtacaagtgtactagtagctgtttgtgcttaaggacaatggttggtgctcagctgagatcttgggtcatttctgatgctgagtaagagatgtctttcacgtatgaatctgtggagtcaagacttgtttatggataatcaaccaatggtgtttttcgccttacaagcggaaactgagagaagtacagagtgcgatactttagatagatgtacatactgtagtacatacagtactgtatctttctcgtccacctctacaagttcaacatgttgtataaacggtcgtctggcgtaacccggagactcttgccttcaccatcattaaacacccatttgtcggcgaactcgcagttcattataaattaataaaattacactaactaatttctatacagtcgtctccttgaagtctccatcgttcctccgtcgtttctccatgttcctccgcaggttcgtcaagacctagccttggttcccatacattcaaatatcccactaaacaccaactcggtaaactcgttgtcgctgcattctaaactgaatgacctccgatctctccagagcatgaagcgttcggtcaagagcctcctggctatggtttcgagtgttgacaaactcggtaaccagacgagaataactcgtcgaccagcccatgggcagacgtcgtcgcagctcctggtcgatctgtgtcacctcctccatgatggtatcctttccagacgttccctgggtaacggcatccattgtagatgcattaaacagtcgaatggcctcctccacatgggcagcgctggccacaggctgaagctccagcttggcaagggcctctgtgattcgaacaatagcttctagctgtcgaacggtgatgggaatcgacgactttctgcccatctgacgctcggcagccgcaacttgtcttctgagctcgacaaagtggccagacagacgctccgatgcttcgtctgacagaacgggagccaccttctgtcgacagtacgaaatgtatcgtttaagcagatccagaggaatctctccctcctcttccgtcttgtttccggtctcgtggatggccatgacgtgcttggcgatggtggcgtctctggaggcattgtggtcatccttgatgaggaaaatcatatcgaaacgcgacaaaatggtggtctggaagtcaatgttttcgcccggcgatttcatgtcgtcgtatcggccgaaaatggggttggccgccgccagaacggctgttcgagagttgagaacggtggtgataccggccttggcaatggagatggtctgctgctccatggcctcatggatagcaactcgatcgtcatcccgcatcttgtcaaactcatcaatacagactactcctccatcagcaagcaccatggctcctccttcgaggtaaaactcccgagaccccgactctcgctgtacactggcagtcagaccggcagcggaagaacccttaccggaggtgtagatggcgataggagacaccttctcgacaaacttgagcagctgcgacttggcagtaccggggtcacccagcagcaagacgttaatatctcctctgagtcgcattccatctggaagtagcttcttggagccacctaccagaaggcatgcaatggccttcttgacgtctgtgtttccgtaaatggacggagcaatggagcctgtgatcttttcgtagagatcgggctctttactgagggtaatcatcatctgctcttcggcttctgaaaagataacctctctagaagggttgagtccatcggcaacaggagcgttgttagaatcaagaccagtcattcccactagtcgaatgtagggactcttgatggccacggcacccttgactccagccttgttgttgttctttcccttttgcgccgagtaaatggcatagacgccgatggccatgattcgagtgccgggaaccacccggttggcgagatagccatcggcgcaaatgatcacgtgacggggcatttctcccacgggcaccatttctggcgcctcctgcatcttgagcacctgctggtcgacaaactcgctcttttcgtgcaggatcttgtagggatccaggggacagtttttggcttctccattggggttggggggtccctggcaggctcgaggaatgttgagagaggcgaatccgggagtcacttcgattttgatctggtctttgcagtgtgagcaaatgagagtgaccgtcttgaccttgttgctgacgctgccacttccgatgatgattccgggcactcgaaccagtcgggaaacatgtgtcgatccgagatctcgaatctgggtgatggaggcgtccgatctgagcgtcacctggacgtaggggaccttggcaatggcgtcgggcccctcttttcgcagtcgctcgtcggcctcatccatataagggttgattagtcgtcttgccacgttggcagcagccagctggaacagattgagcattccggtggggtcgtccgccagccgttgacccagatctccatcgtacgctcggacatgagcaatgtccacttctatggtcagaatgccgcccagaatgttgtcttgcagctggtctcggtagatgaaattgccgtcaatgtagaactcgcggatgaagtcggcgtacttgcgggtgagtccgacgttggtgtcctcgacccggtcgtcgtcgccgggcagcacttgtgtggaatacactcttcctgtatcgaaggacattgcggatcttgtgtggcggggggtgtggtgaggtgttgatgagagttcttttcgcactgggaggaagtgtgcacacgcgttcgttactattcctattcgggacaagtagaaagtttactgaaaaagaatacacgatcgaacaccacaccatacaaccgggtaacgggtgaatgaaacgattggagtcggtaattgtgacctccgagagcttggaaattcacaaatatctccaaaattccgtcatattccgtctatcgtcgcacaatcgccccgtcaaaccccgccacggttaccccctagcaacgcgtaataaagttgccaaattaattaaagggtgagagcccgcgtctcgcggttagggctgcaatgtttgggagtggctgttttggtcggggccgcttgaaacatgcaaacgctgtataagatggatttctgcttactaacattcatcattctattaatacaaataaatacattaccgtacaatcacttgtcgtcctttttgtcgtccttgtcgtccttgtcttccttgtcgtcctcgccctcagactcctctccaacctcatcatccacaacctccatctcctcatcggaggcctcctcgagatcctcgtcctctccgtcgccgtcaccgtcgccgtcgccctcggcctccgcttcaccctcagcctcaatgtcttccttggcgtcagcctcagtctctccctcgacctcctcctcaacctcctcttcctcttctcccgctccatattcctcctcatcgtcttcaaggtcggcgtcgggctgctcaggagggaactcctcgccctgctcgccctcattgtcccacacaatgttgaatcgagtcacccggggcttctcagcaagaatgtttcgcaccacatggtccacctgcacctttggaggggggttgaggcgcagctcctcgctgtcgtactcgttgttgacgtagtatccgactcgtacaaactcgcggtcgttgtaagaacacgacagaatgatgacggtgacagaaaccagctcggacgcgggaatcaggtcaactgtgggtgggtcggccgtgaagacgaacttgttgactccaacgggaaccgggcccaccagaagcgagtcgagttcctggtcgtgttcgaaagatgtggacgaaccaacgtatgtgagtttccattcgaggtctgtgttagtaagagatattgggacattcgtaaaccgaagcccttgaggacccagttgatgaaccaggaatagtaatccatctcaaccccatcaactgatggacaattgctgattagctcaatcaacattgctgattagctcaatcaacattggtggatgctcaaccaacacttggatagatgctgagatggagacactccatggacccctatgacagcctcatccaccagcctacaactcccgatcaatgcacctaaaaaagaaccaatcaacaacttgacatcaatccaacgtcaattagattggaatagtctctgccactggctctccatgtgtctctccatgtggccctccatgtggccatcgcactgcctaccaccgctctccccggtctactcaccatgcttcaaaggctcgagacactcaaaggtgatctggaactcgtaggggctgccgaacggcgcagggttgttgagaacgtcaatgttgagtaacgaaacgatagacattgtgattgtgacggatgtgtctcgtgtgtgtgtagtaggaagaaaagattgtacaggcaagcgtaagacgcgtcacttttaatttagcaaactttaagacaagtgaaccgcgtgagaattgacggtgagagtacgagcgagtacgagcgcacaagtaccgtaattgtagattgcgtgctaggaatgactgaaaaacaaatgtctgatgatccgccccttcgttcgaaacaaaaaatcgtgatcgtaaatatcttccataacatataccacttggttgcgatcccaccgccatacccacggcaactggatctctgctggattgctccactgaagtttcccagttaatcttagaacggaaatctcaaagccgattactcagaccgagacgcccatcaaccgcagaattcggaaaggacaaccaaatggccaagtgcagagcccaagactcgaacgcacaacaagaagacgatttaccactccgacaaaatgccattacagctaagtttaaaaagcgttgggactacacacccagccaatcaagtcacgtgttgcccaacttcaagtgcgattttaaccacctttcgacgcaattttcaagaatataaatcggttattgggtaaaaccatatgtgatagttgcaatcatgctataaaatgctggaaattctgaaaactgacagccgtatcgttgattcgaaaatcgggcgtttccagactctttcttttcggtgctggggacgaaccagaggtcggatgtgacagaaaaaagtaccaatcgactcgtagaagcatgtaaaattatctcatctcaatatcgtttgtttataacctctcaaatacagaatatcgcgacctctgatgtcaccatacagtacaatacatcgcgtatatagcatatatagactattggacaacgaccccccccccccccccccccccaatgtttcaacccgcaagagtccttgttgagacggcatttgtggtcataattgtgccaaaaatcagcccgtgtctcttggcacggccccttcctcgagccgcgccaagaacacgtttttcgccctctcaaaacggcactattctcggactcgtagtagtcggacgcaacctcacggccaactctaaatgccacactctataaagctcggcatgccgggctactgtgaaacatgcataacataggtgtcaccattatcgactatcacactcgcagtccgaaatgtcgtggccggtgtctgcgccgcaaagcgtcaaactgctggcgcccgacgacgagtgcatagccattgaggcgtcgcgatccggctttttcctcatagccctcacccactcctccatctacatctaccagctcaacccactgtttccagtggcggtccactcccgcagcgcatcgagcctggacacgtacggcgtcaaccgcaagatcatcaccaaacgcgacggctcccacgtgggcgtcatcacgtccggcggccacgtgattctctactcgctgtcgattcttccgcatctggagccaggcaacatcacctttgaaagcagcggtaccaagcccgtgctgtacccgggacccggagagagcgtgggcgtgcagggcgtccggattgaggtccgaacaagcatccgggtcgactcgttctgcgagaatgccgttgttctggaggacgaaatcgtactcttcacaagagaccccccagcagtgcagatgctgccactggactcattacaaccgaccagtgtggtgctccgcaagctgccatggctgcgggacgacaatggaaaggtcgattaccccgttcacattgactactcgcgtcccatggacatgtactgctgggtgggagagtctggacggggctacgtggtagtctccaaagagaacagagatgacgacgacgacggaagagagtgtgatgtgactccgaaagatacatcgccaaacggcaacgaacctactaatgagccggaggttgatgaacccgacgctgcaacttctgaccccaccaacattgaactgaaaccactgactgtgacaaccacacccaaaccgacaagcccaccaataacgggatactgtttccacaaatcaaagatcaaggcaacgataagcgccgtcaactcgcgcttctcggtcatcgctctcggcgccactgacggatccattgttctctacacagttcgagactaccaaggaaattgtcttcgagtcacaagaatggtccacccagacacaccggctggcatcacgtgtctcacatggaaccctgagggaacctgtctttttgcaggctacgaaaacggatggagtctgttctcggtgtatggaatgcttctgtcgcactccttccagggcttagatacagatgacgagaaggaagtgtggctacgaggtatcaaatcggcagcctggtccggtgctggagatggtttatttcttgtgccactcatttcaacccccgaaacgccccagctttactgcttggatatggctaagttttctctgtttgaaaactttacccaggacaatctcaagggaccggtgttgttccgaaacaacaaactggccatttatagaggccaccaccaacccgggtttgctgccatctcacgtgactcgatcctgtggcagttcatttgcatgcctgcgtcctacacggcctcaaactggcccattcgcatgattgcttgctgcagtcgccacgagtactttgctgtggccggagcacgaggcctgtgtcattattccatcaattctggacgttggaaaatgtttgccgaggagtacatggacaatgaatttgttgtcaagggaggaatgatctggtacaagcactttttgatctgcggcgtgtacagttttaccacgggagggtatgagatccgagtctactcccgtgatctcgacttgcatgcttccaaggtggttctagtacaagaagtgcctactcagataatccatatgagtgttgcaggtgccttcctgtacgtctacacccttgacaactgtctctatgagttcactatcaaggccacaggtgtcaatggacttgtacttatgtttcagaagatgttgtcgttcacagagatcattaaatctcccaacagggtgcgtgcaatcaccaaatactccaaggacgagtttctggtgctggtggacggtactttggtactgttcagtccgtcggagatcagctctgactcgtcacaggcagttggcttttcgaagcgtactctgcatcaccatattgagtactttctggtcgaatcctcttcttctgaacctcaatttgaaaacacaatctgggcctttgacggcagcaacgtcttgttatggctcaatcctcatgaaattgaaccgtgcaagattgatgtggagaactacccgttaatgccccttgtttccaagggcatcatgctcggtatttactcggatctactctctacacggtcttgttcgttccccatttttcgctttgcgtttggaacagacatcttcctctctgatcttctcaactttctcatcagccgaggcgactacaccaaggctgttgagctagctggacagtacagacagctggactacttcaaccactgtctggagattctgctgcatactaacgtggttaatggagatggtaagaaggacggcaagggtaaggctgcggagtccactgagacatctacagacttgattgtcaagctgtgcaggtcattccccggatacctggatatctttgccaattgcgcgcggaaaatggaggcgtcgtattggcccacattgttcaactcgacagggtctcctcggtctcttttccagcagagtatggagcagggacgactccagacggcctctaagtatcttcccattttgcattccgaggaagatgaggaggcgttttcggataccatagacctgatgcaacaggccaaggagcaaggggaatggggattatgtggaagtctgtgtgactttttggtaggaattgatcgtgagtatgagtggagaaagaaaaagtcttgacaaatatggctcttcaggtttactgtttgatgtctaatcgaggatacatgttgccagctgccgaaactagacatcctctcggcaccgttactaacccagctacaaacaaatctcttaatcgagttttggacaaggtccaactataatagtgtatcatttcaatatataatgtgtttaagcacggttctgagttagtatacgaaagaggtggtggaagatgttggaatgtcaggagtctcatctgtgagaattgggacagttgctgctggtttggaaaagcgtagacgaagtaagaaagaagtaagaaaggtgaccaggatatgggatgttcctgggatgatgtcaggctgaaagtggtcatcaaatgagcagttgagggtgccctataaccagaccgtgtattgatgccagtttacagagctgcgttccatgaggcgtcacgacagagctcagggctctgcaccaactactccagcacaaccctttgtcttagggcccaacagcagaacacgaagtaacagcttgctgctaaaaatgtcacatagcatgatgctacaacacccaaaaacaccacatcctatggcgcaccacacgaccaatctccacacgaccaatctccactcgaccaatctcaaacacccttcatttccttctgtatcgaattgtgttgtttcatcgttaggttgtacgctgtcaaatcttcagtgtcattctcagtcatcttcttcttcccaagggtatcaccttgtcgttgtgtagctccacttcaaacttgctgatagggataatctgacttctttcaatatgccacaaccaaccatggtcggattggccagaatgatcaaccaaccgttattggccgcagtgagagtttccgtcgttgttccattgtcatcctgatctgcaattgacttcatcttcagctagtgccataatcgaatagagtcaatggcatgtgtcgtttcagggtcgttgagggtcgtgtaatgaatgccttctcgtttgtctggcctcgattggggtcgtgtcacgcttgtcgctctcttcatgatcacactctcaacattaagttgtccatcagccagttgaaagccgcttctaatgatactcaccttcaggaacttgtccacaaagttagagggctggtgtcgtccctggatgtcgtcctcctcagggaagtacttgaggaactgggcctgctgcttccagaagttgatgcactcctggtactccatgtggcccttggcgtacagcacgttctggatggacaggtcgtcgacaaatcggtgtcgctcaaactcctgtcgaatcttggttcggatggtggggatggagaactggacctcgtacaaatcggcaaaggtgggggcacctcgcaggaactgtcggtacagagccagggttcgcttctggagctcctgcttggatcccgaaaacttgacggtctcggcaaaggcggtagcgatgatggccattgtgtgtggtgttctttttttcagaggtccgttccggatgctgtgtagcgtaaataatgctctgcagtatagtaataacaatttgggcccagtgattggccggattcgaactttaatgcgccggactgggaagacgtgtttgtagtgtgagaaacgtgtgaatgggggaaaaaaagtggaattatttctttggtaatttggtttaggccggatttgaagacatttgcacttttccgattcccgatcgacaaagtattcgctcttctgcagtctccattccagacgattaatcatccctaaccgcatcaacatcctttcctcccaactagaaccaactgaaaaatacagtttagtgagatcgaaccagactctcaacaaatatcaccaccataactgagtttcctcactaatctcaactaaaaaacctcatcgaaatcacgttcgctaatgcaccccgtgcatgtttaccccagattatcacaaccaagacaacacctccaccgtatcgccaacatgaccgactccctctcgctcggatactaccaactgttccacaagtacgccgttctcggagacaaaagatggcactatctcgacattccacccaccagtccgagccccgctcttcttggatccggaaagaccctgatgctgtgccacggcttccccgatagctggtatggatggcgaaaacagattcccatactgcgcaatcttggctacagactcctagtaccttcccaaatgggatacacccggtccgaagctcccctataccccacacctgaacccaacgaaaagggcgagtatcccgagctcggtcttgaggatggaaccgacgcattgaaggacctgtactgctacactggcaagttctacgcccagtgcatggacgagctgctgacccagctgggtattcccacggttaccatcattggacacgactatggtgcctatctgggtcccaagctgtacctatactttccgcaccgggtcgaggccattgccacgtcttgctggcactacgttcctgctctgaagaagttttttgccatccccgactttatcaagctggctccctcattgtcctaccaggcatatcttatcggagatgcttccaaggactttgctacccgagagggcagtgagccgtttctgcgacaagtttttggcggcgaggggtggggcggctcagactcctctgtccatatgaccgagcccgagttccagaactacatgaccgagtttgccactggtggtcgctttctgagctacatggtgtccacctacaaggctcgtcgactgacgtttgagatcgaaaagcaggactttttggacaagggccgaacgcccgagagcatgcaagttgatgttccgtatctccatgtcggtgctgagcaggacatggccttccggcctccgatgatcaagaatctgcgaaaatacgtcaagccgggaaggttggacgaggtatggatcgacgctagtcattggctcatgttcgagaaggctgacgaatttaaccacgagctggtcaagtggttggacaagattcatggttcccagtcgaagttgtaaagcgatggcacttgagcagaccaagattcagtgaactaagggattcgaaacaatgcgaatgcacaagtatgtactacatactgtactgtacatactgttctacttgtacagtacttgctgcgttcaagtgtctctgtgtatcgtagagacctcttgaagatgtattactgtatgtacgagtaatgatcaaactagaggcctagggacggttgtaaaagtgcatcggtcattccacggataaccactgttctgataaaagatgaatatagatcattgaaagtcttctttcattctaaaatgcctccatacagcccctatagccagtgtctatacgctcagtagcagattggagcccaaatatcatctctcctaatgctcctgtgcggtacccctgaatgtccactctggagaatcgataggctgggttctgatcaatggaccgaatcatagtaccgttcgcccgagccggttaattccacatgtctacttctgatcttctacaagactctacggaccagaccagttctacaagactccaccgactggccaacagagacactacggtcgcaacgtacagtaccgtaaaagtacattacagtaccggatcatcacacaatcatatcaatcgttagttgcatttcatacatgtgttccaaacactcgtttcgtcgttagtggagggcggcgcactggagcgcactggagcgcattggagcgcattggacgcgtactggtgaaggtgcctcgtcactaccggataaagtccagcgtcctagttgtcattctcggcgctcaaactaggcactctctccgtcgttgagagaaactacctggtcctgctccagaataaacgggaagtttgcatattccttggtggtcttgaggtactggatggccttatcgggggcagagaaggcgaagcccttgatgaacgagtattcgtagccaatcttgcctccctttgacacgatggccttcttgacctggtcaacggtggcttcgggggtggagtcgtccttgaaggtcagaatgtacttgttggggatgtattttgctgctgagacaagagccgctaacagcagggtaatgagaagaagcagtttcatggtggtgggtgatggtggcgacctggcggtgtttcgtgtcgttgagagtgtcgtgggagtggtgtggttagtcggtggtgttgcttgccaattataaataccacgccagtcccctttcgaaaccctctattcaaaccctcttgtttcaccttctgacagcaggtctaagccgtgcagcgcagctgaaacgcacagttaactctgtttcgcgggcaggtgatcagacgagcggactcgggggaagcttctgaacagtgacgacgacaggcgacatggaactgacatgaacaccatggcatcaccgatgtcatttcccaattgatgggtttcgtttccatttctccccgattttcgccgattttcgccgactttcgccgatttttcaccaatatcactcggtgatcgactggaccaaggcaattcaaaccactctcaaccaacaccaaccaacacacgccgtccatcgacgctcacagacaatcaaatgagccatacactcacagcccccgtgttccaattataaaatgagacatggggcccaattattacgccattgtacgcatggggtttgccacacacagcataccacaatatacagtgtctgatacgaggaaagcgtacatctgagtacacggtggcagaaggatgaaagaacatgttgggggattcaattcggtacctcgaagcaataagccaaataaacgagcttgttaaacatcttgaacccactccgcccatcttttaattatcgtgaagggccattgctgccaatgatcctgcacagtggctcgcctacatccaaccatgccctccaacccattcagtcagagagcccgagacataaaggcaaagatcgcttgtttgggaaataaatattctatacactgcggtgtgtagaggagccattgtatactttctctgaaggaaatcgagcatcagtcttcatcactcgtcactcgtcactcgtcactcgtcatctcctctcgtaaaccctcatgtcctcgtccacagcaacctccttggtgccatactgaacagcaattttaatgccctccatggtctcaacatccagaaacacatgatccgtttcttggaaaggtctgtgaaggtaaatgtacttttggtacgtgttctccgtgctcaacaaaacctcgtcctcaaatgtgcggttgatgttgatacgtttcttgaccagcaaaaccgcccagttttcgtcctcctcttcaaaccggtgtctgatagtgttggacactcgtcgggcaagtggagtgcgatactgacgtgtcgcggttgtctctgcatcccccgtctccttcatttggggcaaatagcgcagtttcttggccagaaaattcacgtagacgtttctatcgatcgccaaaaccacccagggaccacaaaagaccacagtcgcgttccagttgctcaccccgtggaaacagttccagatctcgcccgtctcacagtcaaaaatggcaatattggtctgcaagtagagacagtagatggacgcagagatgcgtgaaaaggagttgatgaagctgcgcgtaggaacaaaccatttgggcgggaacctcagctctgtatttctcagatcagcttcggacagctcttgttgccctgtttggcagatcagcagtgtctttttgatgccagaagatgcggtgtagctgaacacaaagtgtcccgtgccgtctggatcaaccagagcacagtggacgagcatgacgaggccagatacctggaagtcgctctccatctccaggtcgaatctccacgttgtaaagtccgttaaactcgccgtcatgttgtttccagagttgttaaatttgacaatcaagccaaagagattgttaccgagcggtagcacggccaccggcgccgttttgcgattcacaacgtcgtatgtgttgtgaggaggagtgtcgagcgtgttgagttgggccgcattggcaaatgttcccccgcagagcaagcgtcgttttgtattcatagggtcgtccgattcggcgcccatcttgtcgtctgcgtctgcgttggcggtcgttgtgttcacctccttgagtcccattgtgtagatgctccccttgtcgattcgcatgtcccagtatcgtttcaccacggagttgtcttccacgtggcaccagtgcttttgtggttcgcccaccaccttccagagtcgataacacgtcattcgccagctttcggagcccccgtagctcttgtcgatgtagaaacagagatcgcgggccgcgtttttccacagaaagtcgttttcagcatcggccagcacattgcgggtcgtttggcacgtgtctgtgagcgccgaaagcgacacaaagtcgtcccgcaaatgctcggcgatttttaccatcagctccgccggtagatggttcatttgtggaggggttttgtaacgggctcctcgttaatggtgataggttgaagtataagactggttaagttgggtcacgtggagataactggaagaatgggatggagtgaataattactaaataaatggactgaattgggaaaaacactagaaaatatatataatgttggatccaagcaagcatttcgtgattgctctataaattgtcagttataaagctgacaaaggtggcgatcgcacactatgtacgaacaagagacaacccaccattgtatgaccatgaaaacgtcaagaaaaagacaagttggtacacgaacgagtaaagtatcgtacatacttgtgatgcccttttattgggccagatctcctctcactttgtataaagtctggaaactgtgaccaccattaaagaacccaacatcgtgtcaagacttcgacagtacataccttaccctaccaaggctgctggcatagcattgtacaaggctgcttcgccctacgattctgaacagtttgtagcttttaatttgtccgtgtatcactctctcaatcaaccctatcaacaaaaatgtatctactctatcaatcatcaaactccagcgctagtcggcgttcttccaatcaacataaccctcaccggtctgagtgtagaaagtacttctgtcgtacttggtgagagccttaccatgacggactctatcaacaagatcaggattcgaagtgaacatccgtccaaaagccaccagggttcgatcgttagtctgagcctcggcaacagcactctcaggagtatatcctccagctcgaataataggacccttccagatattctggatccagtcattgttcatccactggggaacctcgaggtcctgatggccatctgttcgtccctcgatcacatgaatgtacgccagatcggggtactgggtctggagttgggtgaccacgtactcaaactgttcacgtgacttgtgctcgtccacagccatgtctccaaaccgcgtccagggactcagtctgatacttgtcttcttctgtccgacttgagccaccacagcggccacaatctcaaacacgaaccgggctcgcttctccaccgagcctccatattcgtcgtttctagtgtttgtgttccatctcaggaactggtctggcaggtatccgttggcagcgtggatttccactccgtcagcgcccgcctggatggcgttctgggcagcctggacataaaaatccacccgttccttgatttccttcacttccaggccgcgcacaaagttctttccgtcttcggtgtagtgatcagaggctgaaactcggtcgtagccgagcgccttgatagtttcggggtcagaagcccgtcccaggtcccacaattggatgaacatgaacgatttggcatcgtggacggcctggactacctttctccagccttcggtttgctcggaagaccaaattccaggcaggttctcgtgacccaggtatcctccggacttttccgagatcattgtagcctctgagatcagcagggtgcccggatcttggccgcgctgggcataatgggtcacttgcagatcggaaggcacagtcttgacgtttctgcaccgagtcaatggcgcaaacacgatgcggttgagcagatggcaattgccaacttggataggcgtaaacaggtttgacggcattgtaaatggttgaggaagaagagttcaaagtttgtcaccattgcttgataagcgtgcactagagaagtgagatttggaggctaaaagaggtgctaacttcagccacgaatcaggttccgagcggagttctgggagccaatgagagcgttctagcgccctttgcgactggaaacggttcgtgcaccgaagggtggttatgcacgaacgaccggtagtagatattgcttagactttgttgaatgtctttgttgatagtacaagtagtgggcgtgaatgagcacaactggggatgttatcaacatacttgtaagaagatggacttccaaaacagtagcagtgtgcccgagtcacgtgactttagatcatcaatccatgtccgatccggcgtcaggttctgtacgggtcacaactgctccttcagcgagttcaatggaaggagtcgatggaaggagtcaatggaaggagacgaccaagtttgatcagactgtggggacatttggctgtagaaacctctggcctgttttagtgatactgtgttgaatcgtagggactcctttgggtcggacatggaagatatgttgggaaatgtgagtaatgtgggggagagagtcgagtttacaagaaaaagtcgatgtgatcttttaggtacggaatcggagtctgaagatgatggatttgaatcagggagagttcttgtacatattaaatagatacctttgttagaagagaacaatgtggcgttcgtgaacgtcgttttttcgttgacgagcgacattacaggattgggtcaaccatcaattattctttcagttttgggaaatgtgtgaatttttcacatccaactggagatgtcatgtattgtacgtactgtactttagatactgtacatactcgttttcgtacgtacaacacacatgttttttttctcagcaacttgaggtgtcaaataatcctcattaatgactctttaaggagtcaaaacttgctaaatgaggcactttcacgcaataagaacctccccgtatcggactcctttcattcttttctctttccaatccaaacatgttgaatcgatccgaacccgaaaagcaaattgtctactattgtgcgactcacaatgtgtatctatacgacgaagacaagtccgcgcacttttctttttgtattggaccttacagctctgtttttcgctgggatttgtgatacattctaggtcgagaccattgtagctggggcatcggtggatcgaggtgtagcagacacacgatactgttgagtacaatagactgcatttcacggtaatacaatgatatgacttgatccagttggagttattgcttaatgtgtgtttgagaaacggggcttaatcgagttcgtttgaagatgtggtttggtccagctctttcgatctactctttcgatctactctttcgatctactctttcgatctactctttcgatctactctttcgttccactctttagatttatcgcattctttctcaactccgcccgatctcaacacatatgagtggagagacgtcccttcatccccttgacttcatctcgtttggcaaacatgaccctatcttccccaagcacactgtttaacacactaccagcatctcgatgttaaaattttttatcaatgtcaaataaagcaagaaattgatctaaaaattcaaagaagagacacttgaagcactgttttggaccatacaatacgtgtgttgaataggaggaaatgggtatattgaatgtactgtagtggcctgtgccacatgcttccagatggcttcgtatcacgttacatttaagatgactactggaacaccctctgtcgtcattgtcaccatccttaattcagcactcccttcgtggccacgcctgaatatgtgattgcgcacgtccagcggttcatgcccgacgtcctggatgatctgggcatcagtcaagagaccctggatattgcctggtctaccttcgcgccttcaacttcgcttcgtgacatcaacatgtatgtctagccagtgactcaaaccagacgtactcaagctctttcgttcaaacctggccactgtactgtacgggtttgtgttccccgtgtcccaccatcggttttttcatctcatatataggccattcctccggctaaacctggtgttccttcgtctgacaaacctgcgggagactggaggctctggctaggtcgagacttcctaggtgactctcctctggctagggtcacacctcctcggtgacgctcctctgtctacaagggtgaaattcaaggggttgaacatgatgagatgatcaagggttctctgttcccctccaatatggatttgaagagaaagatctatggttacgggcactgcactttttcttgtcacctaaatcggataaactaaccgagcagaactgctaggtctgctattgcgcccggtgtagacgtatccctggtgacgaaattgttctcatattctgacataacaaagggatatttagagttcaattttctactcgatacgatgaaccttattaaacccgagcccaccttcgatagctcgaaagattcatggatcaaaagacactgagaaaaagatgctgatatatatttaccattttgattacctaatatatattacgcaaattattatgtgataatctcaatttccatctccatgattcgtttctcgaatttttgacagagctctctctctctctttcgtttaaaataaatgatcgacactattatttgccactaatgcccctctgacaccatgaattgaaacccatttcggcctcatcaacaatataaaaggcctctttatcgcccagtttttccaccgtcagaagtcgaccggtctctcagcatctgcagaggattcggtcagagagatgctgccactgccgagcgaaagcaaggaggtagtcctgtcttgcgcgagcagacagtaacttctctcctaccatgacgcaacttatgttgccgagttggagagtcagcacacctctcttcatgcatctacgggatggaactgtgacgagcaaagattcgcaatctacctcaggagccccttatctcagatggttcgcaaccacgggtgaaattcccagcatgaacaaaacgttggtgtctgctctactggtcctgtcgcaagacaatgatccagaacttgctgagcagaagctgcaaagcctctgatacgacgcaactgttgaaactgattaaaatcgtgcgtgaagaacgcatgagcgagtaactaagacgtagagctgagcgcaagctacgaagctgccgaatgaaaggaaaccccttggtacatgcactacaagaacgcagggtgcggacgagttgaaggcttagaaagccccttgaggatcctgtctccgtgaatatgaagcagtgacggacatgaaacattgtccatgagctctccaaaggtatgggtaactcccatgggtgcaactatcagcatggataacaactcctgaatgctttggagtgatggactgtcatttgaataatcatgtcccctctatctgctgttgacttggtaccataacaccaggaatcacggttaagggaacagctgacacacgatccgatcctgatccagcttgttccgcctgagaataagcgtctgaagagaccgccattgagcaaagcgtttgggcccaaccagccaaaccgccagagcaaagagtcagtccgagccgcaacaagccagaactagagccgccggccgacaaatgccgaaaaaaaacactacgactacgctgaaaagcagtctggagctgtacgaaggtaaaattacacctcccaccagagcaggaaacgttgtagcgaatgatacacgttaagttatgccagcacaagagtgacactgtgaaatgatgacaacagcgcaaaggtgaaactgtgaactgtgagagcagaccttctgaggatataggccagagccaaccaattataagagccactgccatcattataagccagtgagtgccaatgagccaatgagagcgaagtctttctgccaatgagatccagcgctatcaagccagagccaatatgagcaacaagaagatgagatgagagtcactgcatgcgccagattatcatccaagagccagtaagtgctgcaaagcctgtgagagccattcgataagtcggagatccaacgatcagattcgcattcaggaaggatgtaggcgtggaaccttgctatgaggatgtacaccagccgaacctttagattatagaacaagaggatgtaagcactgagctgaacctctggggataatacattatggaccatagagtccaacccagatcttcacctgtagttatttttgcccgagtaattcaattgaattgtagatgaagtcaaggtatggagtgcaggtacagcgatcagtattgtcacttgtagtgtattatactcgttactcaatccaacactttaaaggtctatatatactaaacgatcgaataaaaagtaatctattgcatattagaaaaaccggcatcaaataaactgagcacagtatataaacttttcaatatcaatgaaaatttcccgattcggcaatatattacttatctttaagacgggaaaaacatggaaaagtctactttaatactgtataaattcgtatattgctatataattcaataatatatatactatacgactattgtcaaagaaccaagcagccctcactgatggtgtttcggcggtagtcatggggtttgtctcatcagggcagccagtcctccgttgtgcttaacgcgcaaataaaaaagtagtggaaaatccactgcacccacacacccgaaaaaaaaagccctgggggacaccagagacttacttgcattactagagagaagcgttggaccttgaccacgtaaggtgctaggggtgtggtcgaaaggtaagaaaattggcatctctgtgagattccggtttccggaggtttggcagaatccaccgtctcgagcattcttttgaaggaaaatgagataccagaaggatggggactccccttctaaatcgagtctctcgacgtttcaccctattaaaaactgccagaagaagctgagacgacactgactccaaggaatggaactcgaggctgctctatagggccttgggaggggctttctaccaccccaacactgcatcatctcctgtccggccctggttctgtaaccaccttgctatgtaccaaatggagggggacctaggctaccttcagctgtgttagtatcgctcttgagtattcaaggtcgtctgtggaatcagcccatttctctttggttgctcacttgaagtgacataaaaacaaagagctagaaattatgagaactcaccaaaaatcccacctgaaacgactaaagaggacttggtcgatgtccgttcatcctagtcgtagaagatgtgtcgtaatgatgtcgtagaagtgtcgtgaatgatgtagtagatgccctgaagtgagaagaggggaggagaaagaagaaaagcccacaaatcatcttcagaataaggtgaggtgggtattataaagagaattgtggcaacccatataatctataatgttctggctcttcaccttattttgcatgtattgttagccgttttacggtaataggaagaaaacatataagatatatatacgatgcatattcccaggatataattccttatgcttttttttttttttttgaattactgtatgttgaataagtatcacgactacccacatgttaaggttgagataatgcaatggaacgcataaaatcgaaactttgttaatgtgggtgatgagctgttggccattgaattagattcttgctgattggaaactattattttcggtatctagaatgacactattaagagctttgttgaataatttttttcaaatggcaccatttttgagggcatggcaaattgaggaaagttttgttttaaatatgtaacctgatctgcatgagtatggtctgaattttagatgccgaattgtcatcgcaaaaacaaaaatcatctcacaatgcacacaagaaacatctaggcagataactcagttccattacacacttattgatcaacttaggtatttcacattgaaatacacctcgtcatggctaagcacgtgatccccgctacaaatagcgtcatctgcgctggttcataacgagatcgaagttcaacgccatcaagagatttaacctgctgcaggagttcccaagttattgtcacagagcttcgtcctcacagagatcgatgtgtgaatgggcccaaagcccgaatatacgagtagttgtgttgaggctgatatctctgtaggtactgtacacatcgtaggtgacctcgagaatggaccgtagatgagagtaccatgtcgaaacgacagttgctccgatacttgcgacgattacgaacctctctctcctgtttgatacttggaaacaagacacgtacatcatatttatacatataatgcaatgtttcggatcctgtctaagtgaacaacatacggctcaaaacaatcaataaaataaattatatattccacccacacaacctcaacatccccattgaataacttatccctcctccagcattccattcgcatccactggaggacgtgattgaaaagaccacaactcgaaggttcgagcacttttctccctcgcacccagatgtgattgagaacgagggttccagtgctttctccctcacacactccaactcccctcatctgccaccgctcgtcaccttccaactcccctcatcttccactgcacgtcaccttccacagccccaatctaacttccctgtatcaagatggattacataaaacgcgaattcgactccatacaactccaaatttgacgatgtcgttttttgtttttttgggttcgaagtagtgcataaagttttcttctcattagtccctgcattatcaacgcaaggccagaaaaacatctcgacgttagtttatgcccgatgaaataagcttcgtgaaactggcctgattcccgggcaagtttaaggccttgcaagtttatggcacctcatttaagattactcaacactttgttaatagcttaattttactcaaaagatttcttggagatgatcataatacggaccatagatccactagctttcaactaactctatacagattgttccaacaaatggagcatgcaatagagtttgtgtttcatttcgtttgtgaagaattaattgaaatattttaaccttgtttaattccgaaactttgctcaacagattaccgacattatgtagagtaaccttaatcggaggttccccactttaagaatgggtatcctcaggtgagtctttggagtcacgtgactatgaaatcacgtgatttagttgtaccaggacatatgagtacgggtagctactaaagtacgtaccagtgtcaactgagcgagctcgttacgtcgagcgttcggatccagataacgcgaatgaagaataagatgaagaattagagtctgtagctgagagctttgtacagtgttgtggggatagggtaacgcactcctttatcctacctgcttactaagagtaccttcacaccttgagaatataccggggcagggttgttgtccaggtttctacacataaactcaaattcatttagagttagactatgcagccccccccccgaatggtcctgatgtatttatgttggaattttcaaggcttaaaattggtagctccaaatgaataaaatggtatctgaataatgtactatgaatcactccaaccagggcttctaatcctaacattgacaaagtcggaaacggttatgtgcctgattaggaatattgtcatttttattgaagatgtttcgtacgggtaaaccttaaatataccaacgggtaatataaagaaaaatatctcgtgtagtgatgttacctgattcaagccacaagttctggagttatatggggccctctgataattgctattaggattgcttcatcgtaggccccgtacttgtaaaccaactgctgatcgagagtctcgatctatttgactatgtcgacccttgagacggatcaagccgacttctaaaaggctatctctaccctcgctctggctgaagaagctctcaggatcacccaggccgttgttgaaagtgcttcggaacgggcagctgataccgctgaattggagactactcttgaacatgctaacgtcgaagtgctaaaggccaaagaagaatatgacctttggtgggggaaggttaagacgcacacgacgatcgctccaaccacccctaagccgaaggaaacgattgaggttgaggacggtgtcccgggggatctgtctgatgttcctgaaaaatggcgagacatcctgaacctccccgcggtccccgatatcgagctcaatgtcgctgtttcgaacagtattgaggaactacttcacaattacctccgtcttacagaacctggttaacagcgtgatggaagaagtcatgaaagacgtctctgaagccgagcagcaaaagaacccggacttcgcagtgtgcccctaccccgaggagaaccttcgtcccttcaagactaccagggtgcactgtgacatctatgctaagaaggcctaccagctggtcttgcagtttgccatgtctagccaggatgataggggcacacgactccatctgatgaccttcatggcatggtcagcccacaacttgaaggatcatggtaagatccgtcttttcctcctccagacgactgcgatgtcgtatttctcacctgagcagacattccaagggctcaagaccgaggtggctgctctcttcaaacttgacaaagttcgagttgccaacctcaatgacgagctctcctgttccatgattaaaagcatcctcgagggctcaagcgaagctaccccatcatcaatctgattcaggccgttcatgaccacaacgagaagacgattgaggaggctgtctattactttggagtggaccgtattgtaggtttatcgagagctggttttgggacaccttcaaggatgctgctgctcagacaacctatatgacctacactggtctcgcctttatcagcactaacaatggtcttgaccagactctcaatgtgcgccaggtgcaagagcctatcttggatgcaatcaagaacgacgacaccaagagtttcacttcttggttctcgctgttgattgtctacgctgagctcatgagcctcaagatagggcagcctaaggatagggcagcaattcgaaatcagctcattaccgagcatgtctggtacagtaccaagagtatgcaacggatgaagacaacaaggagttcttcaaatggctccccgatgtctgcaagctggcccactacacggacgtggtcactctccacgatgatgtatccttcgccaaggtgcatcaagccatggagcggtacgtatccgaggtacctacgctgttcaactccctggaacacgtgcaatctctgactttacttcattccgaaacttcaacataaagaaggctcaaggctggctgagtcgatacgacccggtaatgaaagatctcaagaaaaaagagcgagtcatctacgcctatcaccaaccaggtctgtggcaagaaacgagcaaatgagaccgctgatgacgggcagccccctggatccaagaaggcccacctctattcagagtattactctgaccaagcggataaagctcgaaaggaagtctctaagatcatttcagactcctccctgagtgagcaagatattcctctgtgctcaagtcgtgtcttaccgactacatcatggagaagtgccctcctatagagatcctgtgtgccacactgggccatggcacaggccaagccttccgacaccccatcactaagtgtatccttgcaacgcatggaaatcaagggcatcgacgaggcacgcgtatcaccaacggctctctatggtatgctctcaaaaacttcatcaacaagatcgagggtcgtcgaaacggtggctccaaatttgccaccaagaagaactgacaaagtccgacaccgtcaatgtcgctgaagactgcaaagaaggactgagatccacgatctgcaagctttattggctcattgaataaatttacctcccatacattctgacagtgtagggagctgtgcagatctatcaaacctgtactcaacaaaacccccacgcgggattctgaccagaatggtaacagtacagtatgtactgtacacccgtaagtgacctcgaaaggtacatgatcactccggtaacgggggagctcttgatccgactagtggccttgacgacacaggagttgaggagcatgatttgaacgaaagcttgtacctgatcaacgtactctggatgattgctcttaacttcatcacgctcttcatgaagatgtgatatctgctatcggctaccaccgagaagactagtgactccgaactctggggttatatgtcttcgtttaccaacctatcaccccaaaccgtttacataagcgcgccaaaacggtacttgctcaggacctttaggatcgaaggcatcccgaaagctgaggtgctcgatcgaatgcaaggtactgtttcctatgttatgaacatgtacaagattctgtgacagttcctttacaccaggtctccaaggtgaactcttcggagattaaccacagtgagtcctctgctttagagaatgactccctcatttccttcatcctccgcagatagagatttcaggtttgatacatcaacactgaacttggcagaccaccagttgattatcaattttttacccctaatgacgccatgacagatgtcagctacgtccatcgaaaccaggtcacggagaacttacaacagaagtgaaccaaatctttgcaatttagaaagagaatatccacgaccagaaatctgcatctacactgtcaacgaagctcagttgattgtcaatgacaaggtcgaactcaaggcaaagtgatgcactagaacatgaagttgttctggactggtacgaaatcgtcaaagacaggaacacatgagcagtactgtaccccaattcacgaagctacatttccaagcaacgaacgtgaagcaaagatcgtacctgattctggtgattggaaagacacaatggtgaaggagctgagagatcagctcaaaaccaaggctccattgccagtcaaaaagaccaaggagatccgacgcaaccaaatcgtaccggtctcgtgggtgtttacactcaagaaggatattaatcatcagaatattcttcgaaaggcccgtatgccactttttggtacagtaatatacaaggcgaatcctcatttgatgagacctcttcgcctgagctgactaaaacctatttgcccctcttcctatcattatcaggcagacatgacaggaccatccaacagattgacatcagcaacgcctgcctgagtgctgatattggcaaagaaatctatatcagaccgtctgacacattcaaagagaacttcgttgtcaaacccgagagggaccatgaagagtactgtacctgcagcgtgtcgacaaagcaatgtatggcctaaagcagtctggatacctttctcataaaaaccacattgtgaatatcatgtacctcaagacagagaatcagcatgctgatatctttacgaaacaggtcatcactgattctaagaagtctatccggtgaagccaccgcaacatatcgtcgtcggcaagtcttacacaacagagagtcatctagtagtcttctcgtagtctagagtacatctggtagtgctcattcgaccttttctgtcagcgagatggtttcaacgttgatgcgtcctggatgcaagaaggaacaaatcttctggatcatcatcatcatggaacaattctttgggatcaaaatgtacccgacagaaaatgtgcaattcgtcggctctcgtgtcgagtacatcagagagtatatactgttgcagttgatcctaacgcatgccgcgtctttgacgtcttgggcggtcagaagaacctcttgatagttggttcctccactgtagacggcagacgatcctttcaacaaccgaattgggcacgtaggacaacatcatgagaaaaactcgacctagaggtcacccatagacatgcttgcgaaaccagggctgggcgcttggcgggaagcagctgtggagacatcagaggccacggagggcgagattccagataccttggatctgctgagcatggaggatctgaccgtggaaggtcgaaggtgtcaccagagtcgcagggtgaggttcatgtgtacgactaacgtacagtagacggaaaatgatgaccctagtgcactagatacatacacgccgaggacattggtatgtacattctgtacttccatctcgcacgcccatttccgagtgttccaggtgttctggctggtctgttcgggacctttccgaggctgtcttgttagtctctcagtgagtctctggaagttctctgggtcagtcatctccaggatatgctgagatctggggcaaagtacaggactctcaggtcagcaagtaattagaacttttctgagtcgtccctgggtgagtatttctccctgagagctcttcaaactcgaactctcagacttctcggaactctctagaagttcactcaatgctcagtcggcatctatagaacatcgcacctctcactacgcataaatgagactaggactggaacggaacgaggttggccggagcgtggatttgtcagaaacgaataaaaatggagaggtcacgtgaagtgatcacctgacccaaccaatagcgtgttttttccgttctatcgttcttcctgaggtgtattgtactgtacccagcagtacgcgtctgtttactaaactcccaaaggagaaaaaaacgcgaaactctgataatacgccaaaatcgtctccacgactctcaaatcagcaccaaatgaccaaacgagacctgcccaatggcttgcagacggcggccaagcggcgacgcacgcagaacgaacaggagggcgggttcgacgacgacattgacgaagaacaacggacgtacaacaacgagattcgagaacacgaccagcaacacgggtcccaggtgattccccgacccagtctcgacatgtgcgcaaagacgggctaccgaccgggcagcattctccagatttacatgaaaaacgtcatgtcctacgacgagtgtctcgtcaactttggacccactctcaactttgtgattggccctaatggctctggtaagagtaccatgctcgctgccatttgtctggcgttcgccgcccccatcacgtgcatgggcaaggcggctcttaaagcgcagcagctcatcaaatcgaccaaggacgcgctggaggtgcgggtcgtggtcaagaactttgcaggcatgccggacctcacgttcaaacgaacgctgacacgcgatgagaagctgggcaggttcttcatcaatggcaagtcggctacaatgaaggaggttcgtgctaccgctcgagagctcgacattcagatcgtgtccatgacccgtttcctgccccaggatcgagtcaaggacttcaccaccatgagccccaaagagctgcttatcaccaccatggaggatgtcgggtaccaaaacatgcgcagccactacgactcgctggtaaaccagcaggaacacagtgctggcgatgaacacagactgcagctggccacaaatgcacttgcggatctggaccgacgaagaaacgatctcactgacaaaatcgcccagctggaggagcgcgagaagcaggaagagatggtcaagaagctggaaaaggtggctgtttacagtaaaggaattttcctcaaacaggagactgagcgtatcaaggccgaggtggcacagttgaatgccgcgagcaaagatctggctgaggagagagagactctgagcaagaagatgagctcgtaccaacaagttatcaagacatccgaaaatgacatgtctcaaaaggaggaaaaggccaaacagtactggcgcaagtaccgagagctccgtaacaaggataaggagattgcgggcaagatggccaagcacgaaggagactttgaggctgcgcagcgccgtctcgacaagcacgaagagggaaccaaggtgctgcaggacaaagtccaggaggaccagtcgaaatacactgcaatgtgcagggagttggacgaccccgcctttcaggagaagaaggaggatctcaaggccaaactggctgagttcgataaggactacagcgagaccaaacaggtggtgcgtgacttggaagccaaaggacggaacgaatcagacaaggctgatcaggttcactctgcattggagtccgagaggcgtgtaaacaaccggtttgtgcctgtgcagcggatcaacatgaacctgatccaaaaggtcaaacagatcgctcctccggaccagttcaggtacacgctccctgccatcaacacggttcgtcttaaacaaaacaacgtcgatgaccagagaatggtgaatgccgtggtcagggccactgcccagcactttgtggctcgtgattccagttctgccgcccagattatgcgtgttgaagatagaattactgttcgagaaatatccaagccgtttgaggaggcgtctcgtaatgtgcctgtcgaccgggtacggcttcgagggtacggttttgacggctacattttggaccttattgaaggtcctgatcataacctggctcatctttgcgaggcagccaagatccacgctgttccttacagtcgacagggacttactcccgagcaaatctcgaagttgcctccgtccctcaacagattcatctccaagaacatgctgtacaccatcaagcagtcccggtacggacagcggtacacctctaccaagtccgagccgatcgacacctatcctcccaaaaaggattctcagatcatctacgagaaggtgcctgatcggtcccaagagcaggaactacaggagcagtatgatgaacttgtgcagcgactcagacccttgaaggaggaagtcaagattgctaaaagtttgcttcaggacaaggctcacttgaaaactgagactgtagacaagctgcgtcaataccggaccagggaaggtaagaaggatattctggccaagaacctgcatactgccaaggtcaagctcaaggagcacgtcgaaaaccctccagcgggcattgaggaggtcaaggctcttattgaaaagaaacgaaacgagacccgcgacgagattgctgccaatatgcttgatcgagtcaaggtgatcaagaagctgggccagctcattcctgacgctcagaaggacgccattgcgcttgcccgagcaaatgtgttggttgctagtctcagatcccgatacgccgaggtggaggcggagcgtgcccagttcaaagaaaagttccagcgtctcaaggaccgatacaaagctgccaaggctgaatacgaggcgttcatggcgaacaaggaggaggtggagcccgagtacgtgttgtttttcgaagagctcaaggcgcagtacgatggcccggatctccaggcgcatgtggatgcccagattgatgttcttcgccaggagctgacgtttgccaatgtcgatatggatgctcgaaacaagtacgaagaggtgatccgacaggcccagcgcaccaagcaggaggtggtctatctcaccaacaaacgagacaatgccgctgaggagatgcagaagatcatcgacgtgtttgtgcccgagcttgagagaatcgtcaatattgtttcttcacggtttgccgagcttctcaaaaagaaagaaaaggcttctggtttggttgttttgagaaccgccaaggagaaggccaaccctaacgatcctggtcccgaggagcctctcccgttttcccaatggggtattgagattatggtcagtttccgagagggaggcaacaagtgtaagctcgatggaacaacccagtctggaggagagcggtccatttcgatcggaacttatcttttggcgctacagggggtggctcctgtggctttccgggctctggacgagatcaatcaggcactggatgccaagaacgaggtgattatgaaccagcatgttgccgacacggctgcggactttgaccagcagctatttttgctatcgcccaagctcattcacttcaattaccccaagaagatgcgaattctgacaatttgcaacggttccggtgtcgcaaccaagggagccactggaggttccttcttggctctcaagcatctccagcaggtgttttcggaatagacgcaagtatagatgcaagtaaattatagaaggataatgaatatttattgttatacaaaggagtcgagttcatgaatcgagttcatgagtcaagctcatgacagactccccaactcggacctgtgcacaagagtcagtcaacccagtcaggagccattcgaagctccgatctggattaaggagatctccatcctgttccagacatcaaaacccgacagcctgtttcatttgcttcgtctgtggctccatctacatttcaacaacctactgtacagtacagtatgcaaatgtgcaaaaactaaactacaggtgataattcaggagggacttcatagtccataacatattaacccagaggttcgggtcactgcttacatcctcttttctatagactcaaaggttcggtctcgtctacatcctctcgtcgaggttcgactgcttacatcctttctgaaagcgaatcttggatcatgaagatcaacttcggactgcctggatctggcttgtttaagagctggctgtttcaggtctggcccatgtctcaaggtgctgacattctgctctcgccattcacagtttcacctttgcgatgtcgtcatcgttttacagaatcaagtgctggtataacttgtcgtttcacagtttcatttgctggcataacttctcaatcgcttcaacgtctccagctctggtggctggtgaagtttcaccaccgggcagctccaggcggcttttcggcgttttcatggtgatgtcggcatttgtcggtcggcggctcggactggctctttgctcaggcggtctttgcagacgcttatgctcagccggaacaagctggatcaggttcgtacctttggagagctcatggaccatgtttcgtgtccgtcacagcttcatatccacggagacaggattcctgaggggcttgctcgatatcaccctgcttccttgtagtgcatgtactgaggggtttcctttcactcagcagcttcatagcttgcgctcagcttcacgtcttagttactcgctcatgcgttcttcgcgcacgggtttaatcagtctcagcagttgaatccttgaggaagccttgaagctcccactcgacaacttctggaatactgtcctgcgacaggaccagtagagcagaccccaaagtattgttcatgttgggaatttcacccgtgattgcgaaccatctgagagaaggggctcctgagtagattgcgactctttgctcgtcacagttccatcccgtagatgcatgaagagaggtgtgctgactctccaactcggcaacataagagaactcaagttgcggcctggtcggagtgatgtgactgtctgctcgcgcaagacagaactgcttccttgctgtcgctcggcagtgtcagcatctcttcaagtgaccgaatcctctgcaaaagctgagagactggtcgacttctgatggtggcaaaacagggcgattaagaggccttttatattgttgatagccggattgggtttcaattgtgatgttagagatgcattcttaatggcaagcgtaatgtcgatcattgcatgaatgaagaagagagagctctgtcgaggatcgagaacgcgtcacaatgaaccagaatcatggatatatgatcatgttaggggattaagaagaatttatatgggctggtattcgggtggaccattcggtttttgtgtctttttcgacaatagatatttggaggatctgaatgagttcgaaacggtagctcatgggtggaataacggtcctcgtattcgcgtggcaaattgaactctaaatttatgctgaaatttactcgtgtaatggagcgttacaaaactgcggagaagaaaaaacacagacttgatccgcattagctagttggagatcacactcacaaatctcgacagagttctcaaaggaatatacgtcggaaggcataaaactacttgtacaaatggggctttctggcacctcgagcataaactgagctttaatgaacgacgtcgttttgtcgagcctgttttttgccaacttcgtccccaacccggctcgggtcactcattgttggattgagaatcttgtcaaaccgctagtttccattccaagaggtttttcactcagctgaatttgtctacctgatggcgtgcgcagtcgaatcctcgactagggtgcggaggctctggcaatgagtctctgttaaagagtgctactatcggaacgtggtgtgcctagaagtgagttgtagttcgttaaactaactatatctaatcaattaatacttttgatgttcaatactagtcgctaatgtatttgttatatcctcctatctcgttgtcactgtcgtcatatttcaaggttcgggttttacctacgcgaattcaatttgacgcgtcgcgttcaactgctaaaatgtgtcaccaccatcacaaccagacacacaacacccaactaaccgccgcaaacgcgccacaatgagtcgaccacgtgacgacgacgcgagcgatgatggccagcagcggcctcgtaagcgccagaacacccaggacttcttcaggcaccaccatcctggtttcattcggtctgtggagtgcatcaacttcatgtgccacgaaaacctgaagatcgatgtgggccccggaatcacgtttgattctggccagaacggccacggcaaatccgctattcttaacggtttgatccaggtcttttcgactgaccgtaagatgaagggtgagcgaggaacaagtgctgctctgcgacgaaacattaaggacaacaagaaggccaagtccgccaagatccaagatcattgtcaagatcaacaacaaggaggctgacgaagatctgttcttcactgatgaaggagtaaagggatatacaatgtctccatttgagtctgagacgtacggcgatgtcatcatcatcgagagagaaatcttcgagaagtccagaaagctcaaaatcatgaccgagaagaaggagttggtttctgagaagacagaggtccttctgcagatcatgaagcacttctcctaccagttcgacaaccgtcttgtgatccagacccaggagaacgccaagaagagaggagaccctaagagtctgtttgacttcttttacaacggatctggtttcgagggcatcgagaacgaccttactgccatgagaagagaagtcagacagcagcacgagtgcctagactcttctttgttgcaaaccacccttgtcaagaaggagcgcagagacaaactgaaggccgaatgcgaacttaccgcccacaccaaggagctctacgacaatctgcagcggtacaaggccatgaatcaatggttgtattactccactttccagggggttcttaacaatgctctcagtgtaaagatgaagcttgaggacaagtgcgaacaactcaaggaggtgggtgcaaagcgtcgagcccagctggaggaacataagctgactggagcagtgtgaaaaagaaaaccctgagctcgatgcgcagattgctcaggccaacagaaaaaagactctactaaaaaacgagaaagacgacatcaatagacagctccggtcttcagaaagagatgtaaaggatctcgaggaccaaataaggctgttaaaccatgccattgtgaatcttcgagcggagcgagatcagtccaactccaacgccgaacataagcgactggatgcaaagatatatgcgtgtgaagagaaagtcaccactgccgagacgcaacttagagcattcaagctcaagttggaggagaagagaaatatctggaaggatgcaagatccaaatctcagaatgcttcatcgccgagaacccagaaggaggctcaattgcgcgatgcaagggacgaggcaagtcggctggaagcaatgtcaagagataaaggtaaccccattgctggttttggtcaccagttcgtcgaggctgatcgtatcattcagaccaacatggccaggttgagacagccgccactgggtcctgtaggccagtacatcaaggtcaagcctggtactagccaacaggagctgacgctgatcaatagtcatcaacctctcacgagattgctcagatcgtatgtcgttgcgactcctgaggatgaacgaacgctgagaagcatattgccacgcaaccataatcccaccatctattatgtcaaacccgataattacgatgtggatcgtatttcaccctcttcccagttcaaaactattttgcggtgtcttgacatttcggaggctcgggttatccaggccttggtcgagtgggcaaccgtgcacggtaccgctatcgctggtagtaccgaagaggctgttagagctctgaagcagggggcgcaaaacttggagtcagcgattgcccctcataaaacgtccgagaggtttattgttactgcaacgcagagaggctctcagctttcttcttctggggttgtgcagtcgggccttttgcgggtaggaaaagcgattgtgactggtgaagacgtttctgaggccaagaaacgagtcgctgtgtgcgagcgggagctgcagccgctgaaggaggaattcagacgcctggagcaagaggagcagatggctctacgagagttcagatctctcgatgagaaagaatcggtcttcgaacagaagctccagtcgctgaaaaaagaacatgcttttgctgtggcagagagggacacgattcctgatgcccccagcacagatgagactgatcaggccatcgagatcaagactcaggagctggataacagcaagcagcaactttctgagacacgagaggctctggaagcggcaaagcaacgttcgcgtgagatcgccaattctgagacggaagctgaagtggagctcgacaagcttaacgcgaaagtacacgaaaagtttttggctactgaagaagccaacttgaggtacacggcacatcaggacgtggtgaccagcacactgcagaagttcgagctggccaagaagaagctcgcggagaaggaggttgaactagttgatatacaggccaacatggagactcagcttgctgctgcacaggctctcagcgaggagctcgttcctttagatgaaggcgtcgacttggagaatggttttgactattgtaccaagcgtactggtgagttgcaggccaagattgatgctgcaaagacgcgaaacctcagagactaccgtatagtctatgctgaatttcaggaggcggaggaggcataccgacttgctaaggaggagttcgaggcgcagaagaaggacgttcgggctctgggagatacggaggcagaccgtgtccgggctaaggggcaggctcttgcttttggtattatgcagaccagttcttactttggtaacatcatgaagtctagggcagcctcagctgatgtcgttttcgatctgaacaccagaaagctagaagtgaagaactacaagctcgcttctacttccgatgcctcgtccaagggaggtgctcgagatgtggctaccacctctggtggagagcactctttcctgcagtcagctctcatggccgctctgtggcagatggtggatgctcctatcatctgtctggatgagtacgaggtgttcatggacgacaccactcgagtaacggcacagaagaacctgatcaatactctcggaggcttgaggcagtgcgtccaggctatttttatttcccccacggtggtgaagaatagcgccgtggacgacgctagattcacgtatgtggaggttcgagatcccagttttgcttctcgaaatcggtaataaaagatgtaatagcgtcatgccttgaatgtttgtagttggtagtttgtagtgttgtcatttgcagttatgccagtatatcttcgtcgacaacgattattgtttccgatcatggctttttccagagagtccataatcccatgccatatttgcccatcagtcagttgtctgaggaacaataaatgtgcttcagaagaccgacaaactacagttctagcctgcagatgtttcgactatggccagaatccctacgtctcctcacggtagtcgtttttctcctgtgaggattggactggttactgatatgcccagcccacgacctcgtatcgtacaatgtactccagagttgacttggaagtcggggcatgatgtgtctctgtcatgtttaaacggaacgagatctcgtacgagctcacctgtatgatccatagtacttggagtacttcagtacaagtacgacttggctccatagtacttggagtacttcagtacaagtacgacttggattgcttctacctcgattggtagagcttctcgtagcccaccctggctcttaagagacagattgccacgtctgacaatccactcaagcccaaagggaggctcattggtggatttgttgtttgttggaaggcccaataggctccatttagttaacccagtgtccatggtttgcagaggagaggagaggaccacaagacgcgctatgctcctcctccatcaggctaacccgagaagatcaggtcatgaatcggtgccgtcatacggtgcctttctggtccgcagagccccagtggactgactggccagagagcgaagacggaatgtaaacgggtcacgtattacgattcgcccatccccttttttttttgttctggcaaagatagcttctagagaacttcaaagccggtgttgactagcggatcttgacacaaaggcttgttaccacccaggatcctcgatctgcatcgcccaagcttttaatcatcagagggacgaggtcataatggtcaaaaggagaccacaagtgactccacagactgatacaagaccgcgagtgggtgatttttagcggatagacggggagtcgagtcgagtcgagtcgaaccgagaacattcttcaagtactctaccagctgctccgcacgaaaaaagcccttccttcccacacaaactgtctctagaactgtttagtcttgggggggttttcatctacatggcgcgaagccaccagagaaaaacccctgaaaaacagaggtttccaaaaacaaaaaaaggcagattatgagtctcaaccctgacaaacccggtttatatgtctttggctgaatctctgccatcatgcgccgctgcaaggtaaaccggaccaatataattatggtggattgggcaattggggaaatgtagaaataaccagagagacgaaaaaatggggaaaaatggctacaaaatacctttatttgtcgtttgattcgtgtttttttatttttatttacttttggctagtttgtggacttcagtgacactgtttagatggactggctgtctgcagatcatctggtttcggtagcactccagggagatagagctgcggtttttgaggtcaaacttggaccaatggcagcattctagaagctctcaatcgatttatattttcacattttctattgcttctaaattgcagcttcaacgggaccaagccggcttctatagtatgttatgtacagtatgtatagtgcattactttcctggaatgatagatttttggtttgtcgcattttggtcgattgattggcattagtaagcattatccccgtagttgttgcactgagagaggctcgaaacctgtcactttacccgaattccgtccattccgagctcatttttaccaccccagagatacccattaatgttgaaaccgcatcaccgaatattagagtttgtcatcctgaaataatattccaattaatttatttagtcacgtgacacggagggggaatctttttgggaccttgaaaatgggatgaggagtgtcatttttcgcgtcaaaatgtgccaaagatgttatttgatgccgtccaatggtctctgactaatctagagccggcggtggtgcctttggcccattctggcagtctgtgacatgtagagaacattttgattagtcctgaaaagtgagtcaacttgttcaattgagtctagaggcgtccaagttgacagtagtcgacagagatatttccatcgatcgattgcgacgttcaattcagtccacagcaccagttccttgagtccacagcacccgttccttgagtccacagcaccggttcgcttgagtccacagcactggttcgcctgagtcaacatcatcagttgttcgttgagtccacagcaccggttggttcctcaatggcccctcaatttagtcggctggtaatcccgctattttcactggttctggcctcgctgtaacgaaccattgcgtgaagtagtgggtgtagatctagcttgattggcggtaatactcttctactatcattacccttagttggcaatatttgtttagaagcaaaaactcttaacaactccccaacaaaactccactaatgtatataactgtcgaaccaagatgtctccatcaattcttgcccatcatcacggatactgcacctgaaggtcctagagggattgacaccgactctagaacccctcaatatccataataccgtaaacattgccccagactcactcggacctgtatgatagtacatgttagtcagccccatcagaagaccagccattccttctgatattattcagtggatcaggccttttggggcttctgtggtcgaagagttgtcattctggccctaatcgcacatatatataccccattggctgtccatcgtccagatcactcgccataatccataacatgtcccggaacgcataccgaccgcctaccgtccccctagacgagtacatctggtgcaagtcgcacaagatgtttgtgagtccagacgggcttcgtatccacaagattgtttgcaaagggccgtttacctggcacggactaccttacgaggagtaattggtaatttaatggatatgctgtgtgtacatcctgtagtgtacatagcatagtactgtaccgccattcgagtccaggagcccactggatagaccctctacattgtccgtcatctcacagctttgtcatctcacagcttcgtcacttcatagctgcgtcatcacccttcatcgctgtcctggaattcagtgttctctctccttcaagacatggactggatcgtctccatcactagacttctcatcggcccctctggatcaagagccattgataatactccagatatgagtcacaaacacaagccgtggccagcaggccagatcctccttgtttttggcggtccatgtgtgagaaaataaagtgctttgtgcgtaccagggatagggtaggtagtgaaatctgagttagtacatcaactctagacgatgggcgtcgcctgtgtagaagaacaataactcacccggtaactaacactatttctcggtggtcaatgcgtcagaagatatcaagacggtccgttttgcgtttaagccgagtgaatgttgcctgccgttagtaaatttattatgaaaaaccccactatgaatacatcagcctatactgatataccaagaagtgcaagggaggtggtcctgttccacctgaacgcgattcccgacaggcggcggtactgaagggctttgtgagagaggtaacgccgattctctctgcagtcgtaagacccaggtggtgtgtccgaggcagtatcgctttcccaactctagtaacctcggtagtgtgagacacactacccctaacggtaggacagccggacgacgatggcgcagcaattggcgaacgctgttataaaacaattcacttacgtgcaatgaaagttgtttgggcaataaacaataaatgtattagagccagacgatagacaacaatccagcagatgatgagcaggaaaattgagtaagatcgacgtggcaagaagagttacagttacgcagagttaataaggtgttgggagattagagttaccctgtcggatgactaactctccagagcgagtgttacacatgttagacacattgtctccatacaccaaacatacaacgatacagtaaagaacggtatgtacagtacgagacatgtgtatataatcgttaactacaccaaaggggtttgtttccgtgggtatgaacaattgcacaagctgtgttcatggtgcactgtagcacttgatctcgggctccatattgacgatacaacgaggaagtatacacacaatccctaacagctgcttggtacggtagatacaacgctcgatcactttagtaaacatttctcatccgtgttgctaatttgctgaccacacccgaccattcacggcagaattggagagaaacatcaccagtattggtccatggtaggacgtactttgacttcttctatactgtacatactgtactacttataagagaagttattgaccgagcagtcttgggtttcgattctctgagtggcattggcgttattgatatgaactactgccaaccctggactcgagccctttctgtagacgacagcggcatccctggtgggctggggtgttctagcagaacatcgctaagaccagccgaaaggaggtggcttgcaggaggttcccaagcagtgatctcgtcagttttgaactcccttctcgcctatctagagtgagaatgaccccagtgacaacttcacaatgatcatgggtcttgttttctacttgatcgtgacaatttgaaacatcgtaggccgctaaccatctacgtctcgcctatacgctcataaaagcacattaacactggctatggtatcagtctggattatgttgtatatatttatggcctctctatatactcataccactcagaaacaacctacattgttcgggaagaagcgcagtcgaactctgcaggttgccggtagccgcttgagataaacacctgctccacctgatctcttcattctgatagcgatgcgactacgtgggacccgcagttactgtcgactccagaaaaagaatcaagcatgtgagttggtcggttcagacatgatgaacgatagtacagtatgtactgtacctgacggatccacttctgatctctcgatcatttgaactgcaggttccatttggaattttcaacaagtcttcatctccccctaggctgagagattgaggctgttgggaaacgttttctgcgtcgaactgcgtctaaccatcttgtgattgtgtcagttcgggcataattacttccggcagcccctgcctgaagaatctgaaccctactcagccctcatcttaccagccatggcgaccgagacatcagaaaacaacgcgaccagttcatccttctcaagatgctgtatctcgcgcttgaaatcgtccaccgcaggcataagctgctggattctggcggaagcgtggtctcggacctgttcatcctgtgccctgaagctcttctgccacaataacagcgcttgctgaaagtccatgggttcactcttgaccttggttttggccaactccagcagctcgggcagattgtacattcgcgcattgagaatgagattggcggcatcgtgaaactccatttgcagctcttctccgtacagatagctcatcagcacgtcaagcgtgcttttgggcatgggcaacttgatccgatgctgaggttcgttttcctgcttcacacgcagcatatctcgaaagaaaggccatactccctgcaaaacggccttgtggacctccacagtctctccctcttcgctcatgagcttgaaatccgagcccgcggtatttctgatgcgagacagtcccgtggagtgaaccgaggtctgcttggtgagaaagtgggccatgcccaatctggtctgtgcgctgaatcggcgtgaggaacaggtctcccaattggcgtccagtaagagcaacgtgctgtcaaaaagaaaggtgttttggtcaatggcgaaacaggtggcgcccgtttttggttttcttctccaccaacccagtactccggatcgatgcaccactccttcttcgtcattgtagaactgcagacatacactgagccagccggggccttttctctcgcaaagaacaatgtagaagattcccacgtctttgagtgagcattgggcgacaatcctgtcttttatttcgtcctcaaaatcctctctggtgcattctgtccgttttcccccgattggtttcgggttctttggtgttttggtctgttttttcgttcttgtcgttcccgttcttgtagttctcgttcttgtcgttctcgtcctcgtcattgtcgtatccgtcgtatttcgtgtctctcgcgtttctgccatctcttgattatcagccatgagatcaatggtactgtactgtagcacgtttagtaggcagtatgtacagtacgtactgtaaccatatcacgacgcgtcgattatgtaaagtaactttgacgcgtttcaaccgtgacggtgaaaaaaccggaaaaaaaccgggaaaaacggagaacaaccgaactattgacccagagatatgatgctcaaatgcccattgtttcagtcgaatatgtcacctccatacccaatgaccacttagtcggcttttaccgctctcattacacacaaaaatacatctataacccctttgtactgtcctcggaggcactggcctaaccactcgtttcacattcctccgtattaaccatgatgactcttgtccaaacagaatctcctcgggagttggcttgaattgcaacacagcgcgaattgggctgactttggtgcggttttgacaatgccaaaagtccatcttcatgccaaaaccgcatcatcatccttcagagcacccagggcatgtttctcagtcgaaaagtgtccagtaagaatggaagatccattgtgtgatcaaacaacaagtcgctctggcagcttgtgtacaaacgacgatccagcaatacaatcattgaatgttgagttgggtacttactgtagatagggctggtcagtggtagagtattgtatgtaccagcgatagaggactgtatgtattgtgtacacgtactgtagggagtcaagggactactccttcatataatatattcttgtctgaaagatccagctcgactgcgtgtaacgcctgtgtgacgccaatcagcaaagacccacaagcgtcaccaattccaagtctgtacttacgacgttggatccagagaacctgacttgaaacccacggagatctaacaagtaaccattagtttcaaccggaagccaacagttcctccgtcgtaccatctcttttcctccagtatatcatcaccgtgacatatgtatggacttcttcagctcaatagttccttgtcgttgagcaggtcacaggccacaagccagtatccacagagatctcttacaggcacggagatatcttacatgcacggagatatcttacatccacccccccccagaacggatttatcgatctcgatctagactgtggttcacaggtgtgcttctgccgtggtctaccagtggtaaatcgcgaacggaaggtcttgtcggcaatgataagagacggtggataaccccagtgattttccaaatgattttatatcaattgctccccttgaccctcgttttggttgtctttggcaactatgatactcactccaagaatcactaagactcactaagactcactaagactgaccctgagacccactctgagatgtgtaattggaacaaactgtgatccgacgacttcccgagcccctctgttcatgataatcccccaattgaacttcacgactggtgatatggacggatcagagcgatagacctcgttcaaacatacctctaccgcagccttcacaccaacagcagggtatcctcgagtcctccattttccggtccaatctttttggtcaaatcctgttttcaaataccgcagtatttacagatagagggcctttttgtttttctttgtttttttttgtagttactgcactctagtcaggatttactcacgataatgatattttacttaagaatccaagtaaaaagtttggtcaatgcgaacatttagatactattctccgtctaaaacaaaatattcccaacaattcccaactaaattaggaaacataaaactagactcccgaaccttagacctttcgacttcattataggtctcattaaacagatatagagattactaattggtaataaaaagtgtttcaatgcttcccagtccattgtaaacaggtttcaaaccccacaattctgtcaaaccagtttttcattcgccgtattagtcattagaattcccaattaatgtctcctaatttcccccacgtaacgcttcagacttcgtggccaagttggttaaggcgtacgactgttagtcacctaaatggccgccatcgtaagatcgagagttcgaccctctccgaggtcgtctgaatttttttttacatggaaaaactgaacgagttttttttaataatatacagcgcgcacatggaaaaactgaacgagttttttttaataatatacagcgcgcacgtgactcatttaatttcaaccacgtgacttaatctctcctcctaattaaaatgcaattctatctgttctgtgaacttgtacttgtagcttttcctccaaagtaacatccatacttgtcaacccagtcttcaacgtatttggcctgtttcttcgtcttcagaaactttctccttctgataatctgccgccgagtgaacttttgcaacaattgcgagttgtcgctcttcaaatatacgtcgtcgttctcagaccatgcctcctcgtctgccttgagccgttccagtctcatcttctcgtccagcgcttcagtcttgtgtaaaaaggtaacaaccttgtcaagttttccacagtatgaatcatacaccttgatgacatccttcctggtgtttgctttggaaactacgccaagaaggtcgttgatgtcatcattgtacctgtggtagttccagatctcgcgatttcgaggcagatctctttcaaaagtctgggttgtgtattcattagtccatggatagtcgacacggcgttccatggtggccatagcttgatctgggctgtttttcgacctttttctgctctgattccaatcgcacaggggtagtctcttttgcaaccgcttcactctcctgtcgctggtccccaggagaggcaagagatgtcgtggctcacacaggtcgtcagaatcccactccaaagtcggcaagtcagtgcacacagcccctgtctctttcttctgcttggaatcgaaattaggagctccaataatctcggaagaaacgatatcctcgtcgaaagacatgcaatctgtgcatctgaacacgagatccggagtgtaccaattgttgaagcagctgtaggactcgggaatcacagtattttggtcataggtgatgttgaatgtgtctttattgggctcatcgacaactactcctccagctgaagcaataagggatctgagattggtgtcgattctgacggaggcttctgaccaaggagtcacaatgaagaactgcctgctgtgaccatcttcctttagaaacgtcttggcgagagctccttcctctggaaaaaagggaacgtggttgtaatccacggctaccaatctcttagcagcgacctttgaagtcaataacgcggactctctgttgatctcagctgtggttattgtatcgagattggtatcctcctctattttgaccttgaccgtaccaccaatagtatcagtacttggatcagcaccttccccgacagaggtatcagttgtgtggcctaaggcgaatttggacacgttgtgctcggcaatgatagatgtatctttctcctgctgcttggtcctcatggtgcctagcggtggttctccagtcacattctcggaccctcgatcaaatgcacccaattcttccacgtgagtctcaatgagcccggtctttgacagtttctccaagtccaaccgtttttccctcctgctgctcctcttcaccacttttcctgctcctgctccttggtcatcagacttgatccacaaaactcgtcttctttccgctgccataaaaagctcttgggtcgtgagttttggcgcgtgtcgggattttggagacattggagtcgatttcagccgtatttgtgccatttcagcatgtttcggaagtcgataatcggtgtcaaaagctcgtggggcccaacatgaggttcagttcggttgtattctgcatttccgatgcggcatgtgcatgatttgactgaggctcatgtggggtaaaattgaaaaaaaaaaaaaatagaaaaaatagaaaattaaaaaatagaaaaaatagaaaattaaaaattaaaaaaattagaaaaattagaagaaaaaaaagaagaaaaaaatgactacattaatctacttatcctattaataacatgattatttcaatcctcctccaccacgtcgatgacagccacatccagccgaatccagccgtatccagccttttcagcctcatgtaattccacaatctacacaacccacaatcaaccatctatcaaatacatcatccaactatcccctggagcctatctctcaagagaaatggagttgccaaacttggcatacaaatgcttcttgagctcctccatctcgtctcgaatctcggacatcctgctctgggtcttgtcgagcttggcgtccacttcctcctgctgcttctctagtcgcaccatggcttcactctggggaatgtccacaaaggcgtcgccaatcttgaacttgacggtctcgtcctcgtccatcagctccatctccatgatcagatcgtccaggtactctttgctggtcgacgactccttctcatcgtcctcaagatggtccatctgggtgttgagagaagagaagcggttaattcggtcctggtcctcccgcagaacttccacgtccttgacctcggttccttcgtcgagctgggttagtactggatggattcgccagcagactcagataagtgtaaacgagcccttaactgcgcacgattgccagtcgttcaggcatacagccaaacgggtcgaacgcagatggatttctggtttctggtaagtcagcgatcaacatggacacggcaagcagatgtaccccggctaatacatcaatttgtggcctccatctcgatctgttcctttctgcggtcccagttgcaattatgggcacatctgacttcattacaggatgatcaatcgatctcaaccacatctctcagccctacggtactcggtgaggtcgtatccctggttggctgttggtatgcttgaagttgtataccacctagtctcataccacggagattcaattttaaacaaccaaccagaccttcactcataattgccctcctctcaagatcagatcaaagaccaatcacggatgtgtcactgattgccacaccgccccagcaactggcgatggtccattctgaaccgcatctgcattgtaacaacaaattctgtccgcaaatgcgtctctaaaacctcctgtccagcccattactcaccattcgcattgtgtgtagttgtgtgttggtcagtgcactcctggattgtgtgttcaggcgtgcatcatcttgcttatgtaagtgaactctacgaggaggatgggtcgccagttcgaacccggtcaggtggtatttcaaggaaataaccgcaaatcgcgaatcggacgagttataccatcttcctcgacctcgtcaatcggatctggtggatcgcatgatttgatcacgtgacgttatatccccccttcttagacttcctaaatgatgtttatgtatcaagtccagattggatttctccagtacgtacttgtagtgttatttggcttaaaaacagtcgattttgtccagaaaaaccaatcatgaaaatttgcaggcagatttgagctgacttctctgtttccagctcttcagcgccatttcaagtcttccagaatgttctctgttttggtcgttattttcatctcaactttaaatcaccactgaaaaaaaaaaaatcgtgatttttcattattttagagttccccataatttcaagtttcaccgtacacatcagaacaacatcatatttccgtcatattccgtcatatttccaacatatttcttctaaagattggaaattgcaaaaaaatcagaccaaattagtcgaaaatatcgttccaagtcgaaagaccggcctaagatacccacttttgcgcaatacccaacatccccagtcatgcctttgaacaccctcacaaaacttcccagactcgctctggcggtcagcggagggtccgactctatggcactggcctacatgatatcacaaacacccggtttgagcgagaaaaccacagcatacaccgtggatcacggggtacggagtgaatcgtcttcggaggcccaaaacgttcacgaaatcgtctctagactaggtataaaccatcggattctcaaattggacgctttgaacgacacaaaagaactttcaatgcgacaggcgcgttattcgaaactcattgcggccatgaatgatgacggagtttctacagtcgtcacggcacatacccaagacgattgtatagagacattcgtggtacgtatgcttagaggaagtggattatttggacttgcaggaatccagccacgagtctcgtttaatccttatacctggggaggaggtggtattgcgctgaaacagcattcaaggacggaattggcgtctggatggaagctaatgagaccgttactgggtctaacaaagtcccatttacgaaatgtgcttgttaagaacaacatcccctggttcgaagaccctaccaaccaaaacgtggagattgcagaacgaaacctggtgagaaagatgtattacgagtacccggaactgattccggaggagttccaggcatccaatgtattgagactgctggagaagctcaatgggtatcggataaagtgcgaaacggaggcttccgaggtatcttccagattgctagctgcttctcaatcgccagatggaactattactctctctgaggaacaagtgaaaggggttctgaccaaactgccacatgatacgcttcaactagtattgagaaacattctttctccgctatctccgttgccagatctgtctctaaggctgcacagactgcgaggcttgactggacggtttgaagcaggcaacaagttcaaccttgccggagtcgacttctccctcagaaacgacaaatggcagctgtcgcgcgaggtgcctcgacgaccttccgatcacgtggtccagctaactcccggtcgtgtgagtctctgggataaccggttctttgttgtttccgacctcccaaaggccacggtccagtttatcgactgggacagtcatcgagagctgttcaagagcaaggaggagctgaacaaggcgcgagatcaggcgagaaagagaaaccccatcctggtttacgagggtggatattcttttcctgctttacaacgaggtgttttgaatacaatgcccaagtgagtgtacagcacgatatggggagtgcgaggcagcccggcgagcctcgaggatctttcgagcgtctcaagttttgtttattcatcagctgatcagatttcatcaccactggggaagtatgagctcagaaatggctataacgttccagtagcgtgatggcaaacacagctcaacgacatgcccgacatgaacgacatgcccgacatggccgacacatatcatcatgcccgccgaatacagctttggaaacaagaagccatgcactgcagagcagtttttgaaaacaaaatcagcaagctctatggcgagtgcacacttgaaaacgttgaaagattcaatttcgcattcgagggtccaatgaaagctccgatggatggtttgacgtattcttgaagttttatgaagctcaacttctttttttggcgttaacgagggagttgactatgcctgttcgataccgactgcggcaagagatcaacaccgaagaagttctactcgggaaggggggttacttctgttaaggaagtccattgaaaaagagtcaaacctgtcgcgggtccgaattggagccccttttaaaagccgccgttggttctgatatgaaggaggccagtcaaaactgggtaacactacaatgctcaacacccactcgcgaagtcatggctcgattattctacgaacaggacctgaagctggagtttccacatgcggcagatctagttgacattgcactattgtatgatatacctgaccttctggagattgcaattctcaaaataaaggctcaacaggatctcacggtgttgttgatggacctttccaatttatttatctgacttacaatcatctataaatcttagaacgggcgacagtagtgatatatctgcgaccaaagtgttttaataatgctaatactgaaaatcgcgttgcgaagcgcttgctattgttgaattgtacttgaatggcccatcatcacccatttctatacagaaacgtggacacatccatatacacacagtcagatttagcactattgtcaatgaatgtctgaaaatgacaatagtacaaaacggcacttcgaatccatcgaatccattcaacgtcacccaaaaactatctaataatctattgtctatggcaggatctaatcttcctccggcttctgcagtttgtagcccatcttctccagctctccctccagcttgtcaaaacctctctttagtctgggattaacggcgtcctcctcgttgttgaaacctcgctggccctcaaagataatctctttcaagttgccgagaggctccatgagagcagaaagctcgagaagaccgtcaagatactccgcaggagcgacagttagctgatggacgagaatgtcaaagaactggacgtaaagatcggggttcttggaactcagctcctcgcccttgcacagaatcttgatatagtctctccaggtgatggaagaagagtaattgctcagaaccagacacagtagaaacgacaattgaagataacccagtaatgacgaggacgacgagtcttttagaagcacattctcaatgtaccatgacgaatcgagcgagtcaagagtccgttctcggcctgtagatccaggtctccaggtgtgatcgggggtaagagcggggaagttgagagtgggctccttgtcaagattctcaaatccaggagtgatattgttcatctcatcggcaggaatatcgtgcgacgcatccttctttgtcgatgaggacacatcagattccgcaacgggagaggcatgacgcttgtctctctgttccttggacttttgaagagctcccttcaacacaccagcctcctgggcagtcgcagtggtggaagaaacgacaacgtcgggagcaatgacgctggagaccacgctctgggtcacgtgatttgtcagtgtcgcgaagtctgccgactcggcggtatggtgctcctcactgatggtatcgaatgccagcatgtaggggtactgttcggggacaatggagagtgcttcggcgatatcaatggtctggtttgtcagcatttcttcctttttggagtcccatttgaaaatgagcacctctccttccttggcctcgaacaccactccgtttcggacactggtttcgtcctggccccagtgcaagatgtgcgttcgtccgggggggattgatttgatgcctttaaaagtgggagttgaagtgaagtagtagagatcaatgccgacaagccatccggcagggatatccagagcaattgttgtttttggtggtcttgacatgataatgtgtcgttgaagcagactggttggagacgatttgagtgtgtgagttcggcacttgcaagttgttcacttgatatgccttcgtgtttgtgattgtgtcagtgtcaagtgtctgtgtcaattcagtcggtcgtcttcgtcggtggtgtatcggatcggccaccagactgtacttgtagtatcgtggctgtaagagtgagagtggtttgctcttcggatatcagcgcctcgcatatgataaacttcaaagtttcggagcgagtttgagagtgtagaaggcggaaaaaacgagagaaagagccgaaatttctacaagacactctcatagatgccaatggcctactgtcgaaattttggcccatttcagtctctcgaataccgccaaaaacgaccccttttcgcgtcgtacataaaactctaatagtcgagatctctatctggcgcgcagctccagttaaggcggccatgtgaaacacgactctgatgaaagtctcaccttcagggtcgccaaaagaaacaccagggggcttactaagaagggggaatataagagaaacaaaaaagaaaatatccttccctcatctcctcgtctcgtcatgacgaggaaagggaaaaaatgaattctggcaggatcgaactgccgacgttctgcgtgttaagcagatgccatgaccaactagaccaagaaaccaactctgttgggaataaaaagcgttggatgagatatatccgaactctgctgagtaacatggccatcaattttgtgacctttatggtcttctgacgagtaactgggcattttatatcccaccaatagctggtttgatcactctcatgttgtcagaacttcttcaaaccagctttattggagtctagagctcaatggttgagaatacaatggccaaacaatcatgtggacgaagtagaaagatctgggccgagattgaggattttaatcaatacaaaagttagattgaaattgaagagacacacgcggttttctcccgcaaagcccttcaaccgcgtatgtatgtacatactggacggcatactggtagtgtcgagctctccaggatcccaagccgcaatagaattcttttgtatgtactttacggacaacctggatattatacagattccctctctatacttattcgactctttggtctcgaaatgactgtattatcttcgccttgctcatttcagttccactcagcgtgtagttggacctactcatcgatctcaactaaacccaactaaacccttctaccacactacaagcccatgccacggccacagccgcattccaggagatgcaaaaacttgtacaagcatacaaatcgctgcctgaaacacgatatcctgctctatatctctcacttgtgcccagatcccgattcagctgcattgtattgaagatacaagaatgactgcgaagatatagttaatgaactacttggacgttcccatagttccaccagaagttgtgccatacaccaaaagatgtgttatacaccatcaagagattctagacagctgatacacatcgagaggacagacatttcgtcaacgaccaaactggttcctctcatgactaagaaaatagccaggtattaccctactgtattacctaatcaaacccaaatcgcgaaaatcatataatcactacagctcagacgcactccaccacatattagacacgacttttagacgtttgaaaacgtgcaaatcacgcgaccagggtagttgcgacgcgacaaattgacatttacgcgcgaaaacacttgtcggacgcaaaaatagccgccgcatcgcccccttttcccccacgacgccaacctctcatgaccaccccaccaccaggattcaggacgctcagagagctccacatgttgaaaaacaactcaatggtcaatgtcattgctcgtgtgctggccaacccgccgggtctgatttctctcaccgacctaaccatttgcgaccggtcggaaaccgacttcgacgtggtggccaactttgacagaaacccaggcgaatggcaccctacagaaaccccacaagtcggtgatgtagtggtgctgacaaacttcaacaaaaagacgggctaccagaagggaaaccccgttctatacagcaagaaacacgtctccaaggtcgtgttctacaaccagaacttgaagtcatacaacaagtatcctgccctcgaacctccagcagaatacatctctagtcaccccgtctacaaatacatatccattctgatcgatgactggaagcaggaccccagatctggctgggacggagatgcagcagctgtcatgtcgttccccatgagtctcgaagaagtgagcaaaaagttcgacacgagcagattgacgacaatcaagggcaagatcagcgagctggataccgacgtattccaactcactgacgccccaggctggaaggtccagttgggagcttacaaattcgaggacgaaatgagacagagatgcagagagaagtactcatgccacgtggaactcagccacgtgagattcaagtcatatgacaagagctcgaggaagctgtttgcgaaaatgactgaccgaacctccattgatccagtggagggcaaagaactggaatcgttgaaggccagactgagtggcaagagcaaaaaagcagatacggatgcgccttcagaagacaatgaggtgaacattgtgccatccaagaaggtccagagatccgatgatgacagcgagtcagagcaggtggaggactctcctgaaactccggcatattccacccctgaatcttttgagcttcaatcggaaacaaatctcgactcgcaacattctgagacagaagaaatgggcgacgacgccataaatgatcttgtcaatgccgtttgcggatcacctgaaagctcggccaagccggattcgcccttttcacatgacaagtccgagaccgggcagaataagcctcctccaagtggccagcccagaatgacttcccccactccccttagacccgagcctgacctcttgagtcatctgtctcaagggactttaaccaatagagatatcaggtctagggatgtttcaccccgtgcccgtgaagatgattcggagcaacccgtcataccccatgagattccagttcgaaagaaactcaaatccgaatctcccatgtcgcgcacgcctttcagcagacctcaagtgtcgcagccgccaccagtgtctcccgtgtcgcagggaccatcagtgtctcccgtgtcgcagggaccatcagtgtcgcctgtgtcgcaggggccaccagcacaagagtttcctacagcgtcgcagtccggcccgatgttggtcatgtctgagtacatcgttcccgacattgaagagccgtaccttgttgtttcaggggtggtgaggggagccagagtgaccgacaagggttttttgtctttcgcggtatactgcgaatgcgtgaacaaactgttcacggtgaagatccgcaaggaagatgagggagagttcctccttggcgtttccaagcgcaatcaagagatgaagctgaaggcgttggtctcttgggcagcccaacaggaacatgtcaaggtcaatctcattcaggacgagcacaagaacgagaatggggagtcggagtactggagcgtcggcaactcgctggagtggcagatgtaaatacactgacgaatgatggagatgaatacattgtgatgtgagtgactttttgacgtgatgagaggacagaggggtattataacagacgaaaaggcacaacgccattgggttactccattcaactagacgatgggcgtcgtggtggtagaatactgatctggtaaatgaaattcgatggaataccacgttagaagttctcgggacgccgattctccgtagaccagtaacccagtggtgaagtactaattcggacgacgacgaggccaacgggttgtatagacaaaggcattagcgccaggcgaatgcaatcgccctagaccaatcaacaattgagcagctgtgagcatcaaagtcgaatgaggtcaacgttcaagaagagttacagtgacaccaaacacaggtggtttagctacattttctatgactaacataataagcggtttagctacctttccgaatgactaatctttccagggcgagtggtgatacattatcatgcactagtctgcctaatcagcatcatcagacatcggacttgggcggcccgaataagacaaaaattgtatgaaaaaggtggttgatcaatgtctcaatagatagtgcccataaaggcaattgagacgatatagatacattaatttgtactgtactatatatacccttttcactgtacctcttccgatgtgagtccgcaagctcaagtcgtatcgtaaggctgattcgaccattttagccgatataatgttttggaccaggaaccacgagtgcaagaacgaaattgttctacaggtagatgtgctcttgtagtatatctgataccatacataatcgatacatttcaatattttcctgaagatctcaactcatagacgggaagatagagagagcagagactattactatatactgtagtacagttgctaatatgacaagtgctagagacaaagctaacaatcctcgtgtccattaatgctcgtaaatcacaaaacttcattatctccttgaattacgtggtcagtttactcacctcgaaagttgacatgagggagagtctgttttgccaactcgtgtgtacgagtacgagtgttgtacctactgcaagtaatgtacagtacatcccctcctagaaccaaatattcagatgcctgatctttttagtccttctcttgcccttcctcaccactctgctatccctcactctgttcttcctcccccaacctctcttgcaccctcctgtccacagcttcgatactaacattgcccaaataacgataataagagatccaaatagcatcatcataacattgagcaaagggaaagtccaacagaaaagacgagatggcagtgtccatcaacaactgccagctttcttcgcttctatgagggaacctcacatgaatcagtcttcgtacacgtgcctccccagaacctggtctgtacctgttttgagccatataagccgcagcaagtattctgtcatgaacaggagtatacaggggcttcttccgataggcctcaggatatccctgtttaaaatgttccatgtactcctccacaagctggttctccaccgcgggtagaggtatctgtccatatcgacgaacagcctgactccaccattttcttcccagccaaccccattcctgtttagagcggtgagggtaccgttcagccagaagttccagagcagtatcctgatagtactcgttcaaagcgaagactggcttcacaacctcaatttccatggcatctaagcagtctaaaacctccctcagctcctttgtccagttcagatactcaaaagggtaaactccgcctttccgtctgtgtttttggacgattcttttgagcagtgcaactgtgcagaaggccggcagagtgtgtgggaatcccggcggctttcgttccattctcttgatacacgctacaatgacttcgtagacttttgttgatatctcgttagtgtctcggaatcgtcgtggatacctctgaagatacaaacgggcaatcgtgttgacaatctcccttggattcctcttctcgatcagtccgtagttccagaacgtccaaatgagttgtttggaagcgtggctgtcggaaatcgggtcgtagaaatccagccaattgagcccgctcttcttgagacggtggcgatgtctcactaggttggacattgtggtgatgatgggttctcctcatttacagcacatattgagagtatgcattaggttcgtatctaatctgccacatacgagcactttattttttttctggaaaaaacgaatttttatatatttctcctgtttttgattttgaccagtttggttgggttaaaacaagtaggcgatgtcaatatttcacctacattgacgtcgcaaagtcgttttccgtactttatggagtcacaaatagatttttattctaaaaaaccaaaacataatacataatacaacaaactctatatatatattctgcataatacatccattaattataacttctctgaggagaataatacaaaaaactgtatatagaactattgcaataaagactatatgtatgatttgttagatatagttatgtaactactaacaccacgttccgatagtgccaaccagaagtgtcatatcagaagagtgcttgctcattcaccaggaagagattctagatcagcagatactatctacatttcgtctacgatcagcaggtccttcttatgactttgaggaaccaaccagatgatatctgctatcttcaacacaattatgagatttcaacaagattgcaacaacctctttgacgtttgtggttttcgtctcttctccattgactcggatagtcgattgaatgaacagaggtcagtccccgtggtatccctccaatcaactgtctagttgcttcttcttactgctattggcaagtgtagacagttcgaagtttcaatctatgcaagaagcgctgaaacaggcgctgaaaactcctctccatccactcccactctcaaccccctctctcctcatgttcaactcaagttcaaacaccaacatcgcgctttattggggccaggaccaggctggaacccaactgcctctgtccacctactgtcagtccaactctgccgacatttacgtggtttctttcctcgactcgttttctggcaaacaaaccaacggaacgggagagatggcggtgagctatgaaggacccatgacaagtctgggaggcgaaatttcaatctgtcagtcgctgggacgaaaagttctcatttcactgggaggagaatcaggacagtatggcctggactctggcgccgatggagaaacactggctggacagctgtgggacacatttgggggcggaaagaacgcgtcagtacaacgaccatttggaaacgtgattattgacggcttcgatctcgatatcgaacacggagatcccgtggggtatggagatctcgtcaacagattgagagtgctgtatgccaccgacacttccaagatgtactatgtgtctgcggctcctcaatgtccttttcccgacgaatggattactcaagccctggagcagtcagaagttgatttcgcctttgtgcagttctacaacaacgactgcggtcttgacgagcccaaaaacttcaattttgaccaatgggcagactttgcacagactagggcagccaataaacacatgaaggtgtttctgggcgtgcccgcaagtcgtaaatctgcagacacgggctacgtcggagtccctgtgctcacacggtacattcagaagctactgaaccacacttcttttggaggagtcatgatgtgggacgcttcttcggcctttggcaatagggaccatggcaagtcgtatgtggagtatgctaagggtgctctcaatggagttgtttccaatggcgctggaacgaattttgtttcgggggtggttttcgaggtggttttcgcggttgttgtggtctggatattgtagacaatccaagttcagacatggcgtcacggaatggctgttttgaagacagtacgggaaattgtatggcacagtacagtatgtacagtgtactacaactcggtccggatacaggttggctagttctgcattcggtactccttctacaggatgagatggcacatcttcgatatcctgtccacaataacccagacatattgttgccttctaggataggtgtcgtctactctctgtactgtatcttatcgaacacgtcttacagtgttcacagtggtgatcaagtccagaagtcaaccgctggttgcccattccattttgaaactatagtggaagaactcggtgactggtgtagcaacatcttcctcgccttgtcactgggaaacacagcgttcgcctaactatgagtattcatactggtgccagtaccggacttcagagagctacaagtacaggtacagtactgtatcgtattcttaagtagtcgtatttgcactgtaataccctccagtgacatatgactgactgatacgcccataatagactagcaagacgtgtgggcggttgctataggaagaccggtataaaagctatagatctgcttaatatgattggatacttgaaaattggggtcagatagtcacagagatgaagtaaagacgtgaggtgatttatttgtgggtctttctatgacgatattttgaaaggaagacaaatatcataccagtagcctaggggtgctgataacacccgtctagtgcaagtaggggtattgggagagctagaaagtgtcttttagtttatatttgtcgtttgaaaatgtttatatttgcatatctccgctttttagtcatatttgtatcgtgacagtgtgattctcagacaatgcttggattgtatgtcaactaaatcgtaactaaatcataactaaactctaactaagctccaactaaaatttatctgaaaaacagagaaagataacatagccctcatttgaatagtataaaaaaagaatggaactgctcagatctctgaaatttacaatcccatctcttgtactgtatatactaaagcattgtagaaacaccaccttcatagaatatttattacgtgccacagaaacatatattcactcaataaaccaatctggactcaaacttgatgtcgaaaaaaatcatcagaaatttatccaagttgtataatcatggtatcaatctagagcccttgatctcttgaatcttttggtgtctttaattttcaaaatctctactaaaaatccttaccaacagcaacatcttacatcccggacaagatacagcccgtacgtttgtagacaaaaagatagcagtaaatttgaggtggacacaactgatatctgagtactttcccaggctttgcggttcgaatggtagtgttttcatacttgcagcattcctctggcagattctgctatagtacagactgtactattcgaaagaaccctggtaagcacacccgtacaagcacaaccacatgtagagattacaagcagatatctgatctcattgagagagacagagaacaactttgcatgcaagtttgcagcttatgaaaaaatggacgcattaacgatggcatttcaggacaggatagttcaagtgcaggtacaagtatgtacaagtacaagtacaattacttacatcacatactgcaccgatttatgccgcacaaaaaaaacgcacaaaatcaacggagacaattcaatatggggatcaaaatgacgagaatcacgatttgttttgatttaatggctatttatacagaaaattattgttttggttcaattgcttcggaactaaagttgggtttcaacaagtacgagtatatagctgtatgtacatgacgggcagcccaacgtgctgacatatagtcgaatcagagtcttcaacttttcagccgtttcagcctttcaagccgtttttcgtgcgccaatgaggtggtttgtattttttttgttttagtgtttgttttaatttttttttaaatttttgattgtgttctgtctgttgaaggtaatacccggtggggtaatggttgaccatttgttgaattgaataagagataattggcttagtaaacaccggtgatgccattggcgtttatttaatggtaataaaagcagatttatgaaataattagaattaagaatgcaaaaagaaaaaatatatattcaacgaatggcggggtccatatctgagcaccgaaatgtccgacgcagaagacggaactccgacaggctgaaaaaatagggtgaaaaactgcctgaccgctgcattgacattttgacaggttcgttgtacgtacaagcacaagtacaatgtgcgtctatgattgtttgtacatgcagtggaatgattctgattgtacgattttcaaccaaaaaaaagggggaaaaaagggaaaaataccgagccactctccaacccgccacctcgcttactaaccccgccaacctcgcttacgtatgccaaacaaggctaggttagggttgaccgttccaagggtactcagtaaataggggtaacatgcatacggcaaaaaaggaaataggctgggctgggttccagtccaagaatgtgtccgtttgggggccgtcaaaagggatttcgatgtattagggtagatgtaaaaaattagggtagatgtggctatattagggataggctaagatggtggtgagtgtccggtttactttttttacttttacttttacttttacttttacttttccttttacttttatttttatttttatttttatttttatttttatttttatttttatttttatttttattttatttatgtcttgtttttattttacacattataaattctatttatgtttctgccggtattcgataatcaacattggcaataaagaatcttaggttatcgtgcatatcctaagcctaattaacgtggtagggtaacttgttgagtggtgtggaaaatgggcatattttggggattaaaaaaaaattggacgggaaaatggaatatccacggaacggtcaaaagttgaggaaggcggaccaggtcaattggtcaatgaggttgaattggctcaaatattagggcaaaaaaaccacaccaattgtggtcctataacgcccaatattggtgttctacgactaccagtagttctaacgagtagttctaattttacccctttttacgtccactttgtctaattggattggcaagaaatgcaaattaaaaatgcagttaaaagtgcaattaaaaatgcaaatgtgtcatgtacatgctcgtttctgtactccacggacagcaactttgaccccaattggacacctgtcgtgtcccaaattggaacgtggtagcatatatttttgtgcaacgtatttcacatgtatgcagagaacatgctaggaggtgggttgaggcggaatcgggcggtgcatattagggtaggtccaaatcgggtctcagggtcgagggttgaccccaaaataagtactagggttagggttggacccacaagggcacgcgactgtgggtctgcatgtcgacgtataatgtgcgtttgggtacaaacggtttccagagggccgaggtgtatgcgatttacggcgagtatgatttgattctgcggtacaagtatgtacgacattggaacgtacgatacaagcgatattcgcacttttacttgttttttggtacaagtacgtacgtacgctattcactactcgcacttgtcttttttcaatggaggtcagacattcaaaacggccaaattaagcgatggaaacgacaaaggtggtagagcattctttcccgcgcgatatggacggttttgcagctgtgcggtaatgttgagacaggcgagttacaccagtattctgtaggtacgtagacagggtacatcatggccgcaaaaggttaattccagagctggatcgaaatacaaaagactatttacaaaagggttggagagataatattttggcgcagattagagttaccgattaaggttgctgccaagtccatatttccaatcaccgtcgaatgagttggagccagaagggcgagaacagcgagaacgatacgacggaaagagacccgcaacgttgcttttggtgggtccaagatgggggagagtcgggagacgggaagttggttgctggtgatccgcagatattcgagtctatggctgatatgtttttcggagttgaacggagtcgagagggagttgaaatgagtgagtgcgtgagtgagcgagtaggcatgtacaagtatcgcagaccaacgtaacggtagtagttgcgtcattaatggagtaaagagcgtgttgcgactatgtatgtacgatacgatatgagtacgagagtgtttattgagtaatgaaccattcagaacgtcaaccaatgaacagttcaacaaccaacgaacgactcaaccatagacgattcctccaaaggacgattcaaccaataaacaactggataatcaatgtacatctggataatcaatgtacaactcacaaccactaaataactcgaaaactcgactccactcaacgctctcttcctcgcatacagccggtattgtacatattctgttcagtacatacttgtaatctactcatgtcgtaattatctccgctacgctagatagtgttgaactacgtaccaagccaagtacaatatataatatacaactacgacgtattatacaactactcgtacaattactcgctcactcacaacggtggcaaagcccgtcctcgatgaccgcacggttgctccgtatctccgtaactctctccgacgaaggtatcggatatgtgtaatgctgcagtctcaacggcgtcagaggaatggagttcagacggcgaagggaaacggcaacggcggcttagtaagcggaaccggatatggatatggatatcggatctcggatgccggatctcctccgtttcttcttgtctccgcctccttctccaccccaatcggtctcctcctttcccccagacagcaacgtcacctctctcacctcttacaactagtccatacggtttgagattactatggtaaagttgccatttgactttgagagagagagcaataaatccgggatttgccgcggaaaggcccccgagcgtgcggagacgggtcacgtggaccgcagaataccgccaaaagtggcccttttctcaagggctttttttccctgccccaaaagtccactcgctcgcccgccccatgttgccgctgcgggccaatcagcggggtgcaatttaggcttttgtcctcctgcacgctgacacaaaggccaaactctaatctccttaggtctcagtgcatccacctctcaccgcacgtctatcgtaagtcttcttccaccttcatcattccgattcttccatcatcatgactactattgatagttatcccgttcggtcggatatttacggtgctcaggtggagccgacacagacggcgacacagacagagacacagtcagagaccctgaaagaggcgacaacgacacagacacagaccctgaaggaagcgacccaaacagcgacacagacacagacacagacacagacagcgacacaagcaacacaggcgacacaaacaacacccaccccacaaacacaaacatcaactaacaacattgacatggcgacaaacacagaaacaggcgcaaacgcccccgacacaaccgcaacggccgccgcagccaccttcacaaccaacaacacggtgggagaggcgggcaacagggcgggaaacgcggtgacctccaccgccgccaccgccgccaccgccgccaactccgaccacgtggcgtccgtgtcgcaacacctgcgccagcgcaacaactcgtccaactcgtccaactcgtccaactcggacaactcggaaacgtcgtcgtcccagtccaactccaactccaactcctccgacaccgccgcaaccactctctcgcccaccacgctcaccgacggcaagggcgccgcgggaaccgccacagccaagaccgacatgcatttcgccaaacaggccatccgcaagctgtcggccgacaagggcacccccaccacctcggccttctcgtccttcagcagcacaacgtcgccgacccagatgcggcgccccaccgcgtccctgaacaacgacgaccccaagccgtttgcgcgccgtcccagcgacaagcgctcgcccggcaaggtccagctccagcagcacgacaaacacctgcagcagcagcgtcagcagcacgacccccgtaatgacactacccagcagtcgcagcagcaccagcaatatgacaaggccccctcgaatggcccgccctcgctgacggtgcgaaccggattcagcaacccccagagtgccatccagaccccggcctccaccctgcctccctcgttggcgtcgtcggtggagattggcgcccagttcaccttcacatcgcacaaccggctgaacgagctcgccgccgaagctgaggaaaacgccgtcgaccaggcggccgccgaccttggcgtccgaagacactcgtctgcatccaacatccaggagtcgcacatccggcggcagattgctgcccaggagggtctggccaaggccaactcgtccatcgacctgctgcttccccccgtcaaccgcaagcagcggctgcgacagtaccagcccgcactggccaagtttgatttcgacgaggctcttgcgcacgaggccgaggtgaatggagctcccatgggcagtgccgctggcgtgcccggcgccgaggccaccaacggaggcaccccgacatctgctgcacctaatggcagtctcggaggagccaacggaggatctatggccgcggctgccgtcaaggctgccaccgccattgccggtgcacctggtagctcgcgtccctacgatttcgcctacgaggacgagatttcggcgtcggctcctgccacctcccataagctgcaccgagtgtgtagcaatgagtcgtctatttcgaccatggctccccccaagcagctgcacacccccaagacgcccatgtacgtccccgcagtgctgcgaacacagaacatgactctgtccacgtctcctctttccgattacggagagaccgtgcacgagattctcatggacgcgcccgtcactggtccccctcgccggtctcactggaagcccgacgacgctcgtcccgggtgtgccatctgtgatgtgccgtttaccttctttgagcgacggcatcactgccgacggtgtggagacgtcttctgtggacagcactcgtcgtactcgctgcggctggaccagcactgcaacttcaacagccagggttacctttcgcgatcgtgcgacatgtgtgctcaggactttaacgagcatgttatgagcgtgagtcgacggctggaggagactttgggctggggcagcagtagcgctgccgcgtgggaggaggtttccggtgtagctggcaaggctcgaggagctgccgccaatggcgctggtggcgctggtggcgcccatctacgttcttttgactcgccgtctgctgccgcgcgccagcgtttcaaggccactggtcccatgcgtcagatgccttctaagatggagggtggcgcggggcctcagggccagcagccgcagacccaggacattgaggttgggtctgtgcctgccaactggaactggtcgacgttttgacgttgtttacgacgcacgggaccggtccacacaataacacaagcatatgcattaatttataggtaagagagagagatattttgattctttgggtgtataatgtttgcttttgggtccgattatgttagggtgaggaatacagtgggctttagaggttgtgatctcctttttggaacgatagctattctgggatgtggcgatagcggcgagacatcgtttcaggtggcgatggagatgagcagtgcggcggacgtacagggttgtatagaagatggtgggcattctgtaccccgctgtagatacacagtgctacagatgtacaagtacagtatgtaccccagtgtttcctaccgtgattgtggtagtggtatggagtggggatggagaatggatatcgagagatgagatggctattgagatgagatggctattgagatgagatggctattgagatgagaatacggctatggagatttgtcgagtctgagaccgtctactcgtattcgtctagggtatcttttacggacttactgtgatggtatagtagggacaggtagatatacgagtacaatacgagtacaatacacatcacacccaccatcgatcttacaataacggtacaatcctcgttcgacgacagattgtgtggagctgagcgagttggacacatggcgagcagggtattgaacaagcagacatgtacatgcgatagtacgctcatgatatatgcagagaccattccacaagcggatgtatctagaactgacaccttcagagttatgtcacgatccggtggctatagctatagtatgtattgtactagtacgtagaacacacgtacattccgtactacaagtacatacagtagtctgatttcacagctacagtaatgtcagtaacccctaaactagtgtttcaacaaggcatctgagaatgggaccatccggagccgccctggttgtgtcgttgctggtgccgttcattcatagcactcttgtatagtctacaggggtgtttcattccagtgatcgtttgggcggataacgtgacggacggataacggacggataacggacggataacgcgacggatacgcagctcatcaacactcttcaacactctttaacgcctccaacgcctccaacgcctccaattcagtcgttatccccgctaggctaattcagaccggtcgactgccgttgaaagacgtttgttggcggctgcagctagccgacaaactctgtatctaggttggatgcatttctgagatgtttgaaactctgggccggatttaaaagatgatttgcggctcgtgctcctttggggcagtttgccgagcgtgcctaacaggcctcgccggctcccgcgcagcccacacgcatacgtactggcttccggctgtctttgaggtgcattttaggtgctggttagaagggcccaaactccgcttctccctgggcccagattagcgggaaaaactcgggagctgcgagtctaccaaacccggggaattcgctgggcggccgaagctgcggcgggcgcccgggagcgtcttcttcggcgtcaggacggcaacctgcggtctaaactcgactacaacgaacgttgctacaaacgttgcacggcactatactatcggcgagccagggacaccaaaaaccagtctggacatataggaaccacgctgtttcggagcataaagaggcaggcaggaaaatgacaacgcaccccgagcgctatctgaactttttgggccattacgtttggcaaaagaaagcgcgatgactattcctgcatcgtgattggtggaccctaacagtagcatcaattaatgcacaatccgcttgaccagctgcagttgtctgctacgtctgtatactgtcggcacagattcgggccgggttggtgactgagtaggcggttgctgggtggtacagtacttgtacagtatgtagttgtaggagtaggagtaggaatacagatttgtacatagttgtgatcggatcaatacggaattactcgtacaagtatcaacgagaaactggaactattactcttgtagtagttgcatcctggatctgagtatgtatgtacggttatagacactgtcggtcgtctacactcgtctacattacaatacgacttgctcttgtacaagtacattctgtaagggcttatggcattccttccatctggctgccaccctttacattctgtatccacaagatcgactgcagatcgactccaccataatccagagcccaaaagagttctcaccacttgccaaggataggaatgacggtagcaagaaatggagaggagatatgaagatatggagttgggaagggagcattaaatgtagccatgagcaagtggctgtatttgtgagcctttgtgatcaaaaccggtcagagtagagcttttctggatcagcaagtaaggcagctggagtagtctgacactttcatacatttcctggtggacagcagaggcacactaagctacctgcttaccactctgctgttggttaaactacctcgtttgctcatttattgaatatacgatccatttctttccttacggattatgatcaactctccattgagacactggtttgagttcaactagactcttaacaaattaatccccaaaaaaactatttattccccacgaactccataaatacgtaaccaaaaacagtagttaaggcccaaatctgctatattcaaccaggtctaccaggtcgtctgttcttcatttctctggagtatcgggaacactgaaaatgaacccccagcccaactttcattttaactaattgttaactaactcacagggttgatttgatgtcgtctgaatgtatcatgaaatgacaccataaaaactgattgaacgagattcatcaccaatattctcgttctccaaaacaaaatatcgactcaaacaactccatatacaaaaaagcccacgtggggcttgagcacacagtctggagatctctaatctcgatcccggggttaacaaaaagagaatacaacataaaaataaaataaaataaaataaaaaatgtaaaaaaatgatatagaacatttatatactcatcccgaccatgaatgacacacaaaagaacccgcagtagcttcacaagtcacacacaccacctcaaaaaaatttaaaaatgataaaaatgagcggtaggggaattgaacccctggcacctgctaacaactcaatggaaggcagatatgttaccactacaccaaccgccccgaaattttcttgtaaaaaatgaaaaaaaagatagcaattctgttttatgcagtcttgacttacaaaaagttgacttgaggagatgtgatgaagacagaagatgatttggtgtattgagtgacaagccgtaagtgttttggacgagtttctgggccagttggtcaggtatttatcacgcaactgaatgtttttttgtttctggggcctacaataattattgatgagcggattagaataaaaaatggtaataggacctgaatattgaagtgggaggtgatgactgtccagagacggtacggccgcccggtttgtacttgagtctaaacctcatttttgtacaaatgttcctacaagtagtctacatcacattctgattctacacctgctcctagtctgaagtagttggaggcaagtaacctgatttatttggtgtattcgaagcaaggaaacaaaattattggcgaattattcatattcacagccaaacacctttgtagacattcattggcttgttagaaggagctacagtaggtagagtatgtacctacaacacaaggaagaaatgatctgtatctaatgcaaagtctgtatatgataaaggtatgtagcattgtagacacacttccagtatcacattggttcattcatacattaccaagtcttatcttcttcacaagccgtattgttatgatattgtggagcctacgagctacgagaggagattcaatccccatgaaaacatcctaaagtcaggcaaaaggtagcacgtttggataaaaaggaatcagttacactaaaaaacaacttcctgtctcacctgtatttcttctcgcgcttcggacgtctcgttatgcccgacagagatccactgaaactccatcatgaggattctcggaatcaccgtattatccactaaaggattctcgagctaatatctgcaacactagcattaattcgctaccccgcagctactcatggaccaatcattctcttttatttggctggacgacacccatgcgggctaaagtagcgtgcaaaaagctgctaatgacataaacatgggctactaaagaaacgagtgagcgagtagacaggctaaaggggtgaaagaatgtcattcaagtcttggctattaatacgaagagaaggacgttttatacgaaatgttataacggtgacagtcatgacaagggaatgcaaacaagagtggccaactcgacttggaaagatgcgaaagaaagagagagaaaagattacctaattgaattatacgtcatcttcgaactaccccggaagtatgactactagtctcacgcagctttgatctaacatctgttgtgggagggaagctgggttacaagtatgaccatcgtttgataaaggcattcatttgataaggagaaaacaagatagacacgaggagttcaccaatgtattctatagctcttcaggatgacagttatacactcttttctgtctcaaaatcaccactgatctccaaaagtagcagggcccagccatgcataccccaacaattggagcgcactaaaacaatgcaaacccggctaaaaaatggggtaacggtaaagtcgatcgatatataatgttgcaaccaacacctgggtttacagcaattattcatttactactttcacaatgttctggaagaacatgaaaaatgagccgcgccaggttcttaactcgacactatggctttccgtcattgtctttggtcttctgggctctgcccgaggtttggacgaaggcatgattgctggaacaacttcacaggcctccttcgagcatcaattcaatctcaaagaccccacaaagaccgccaaccaacaggccaacgagctgtccaacatcacagccatggtgcagattgggtctgttggaggggctctgatagccatgtttgtgcaggatcgaattggacgaatcagatgtctgcaagagatgatcattctgtggacggtgggggtcattatagaggtgacttcctactctcaaggacaactattggcaggacgattcgtggcgggacttggaatcggccagtcggtggtggttgggcccacctatctggctgaagtggcccccaaaaacgtccgaggactgtgcacttgcatcttttcaggctcagtctatctcggcgtcatgttggagtactttgccaactactccaccactttgcacatgtctccaaacagccgaatccagtgggtgctgccgactgctgtgcagttcatttttgcaggtcttttgttcattggttcgtttttcatcaaggagtctccacggtggctgatgaagattggtaaggacgaactggcagtggagacactatccaagatcagacacctgccggtggacgatctctacgtccagggagaaattgtagacgtgagagaacagattgagcgagagaagcaggcgctcagcggaaccagcatattgtctcttctcaaggaactcgtttccaccaaggccaatcgatatcgcctgtttttgggaatcatggtacagctcctgggacagtggtcaggggccaatgctgtgactgtctactctccaaagttcttctccatgctcggaatcccctcgaaaacggaccagatgatgtacacagcggttctgggtgtcatcaagttcacctcggccatctgctgtgccttgttcctaattgacaccattggacgccgaagaagtttgtacacgggcatctgtctgcaatttgtctccatgttgtaccttggcatctatctcgccattgtgcctgcaacagttggagtagatcgatcaccgtcccagaagaaggctggaggagccgccattgctgccatctacctgtctggctgcgggtgggctctgggatggaattcgatccagtatctgatcaacgcagagatctacaccgttcgtcacagatctctggcgtcgggaatcatcatggtattccactttgccaaccagtacggcaactccaaggcgcttccgttcatgcggtctggtatcaccgaccatggcagcatgttcttttttgcgggagtgttgcttcttggactggcctggtcgtggttctttctgcccgaggtgtctggacggtctttggagagcattgatgagatgttttcgctgccctggtaccagattggaagacggggacacaagctggttcctgaaacgggcacggtgattcagatccaggaggaggaggagaagaaaggaggtgttattcatgtggagaattgttaacccggtgacaattgagtgtgagttgcacacttgtccagcggtccagttaacagccaggaagaattgcacagggagtattgcacagggagtatctcacagggcgcatatcagccaggggaagttgtatgtaaacagtttattggagttttgtatcgtcgaaaagttgatccagtcacgttattctgatgttggaaccatttagaccagaaaaactactattacatagaggagatctgaggtcagaatctcattattcaccctacccgtggtacagttcaaacagctccttgacactattgtgcacacatcgcaactagttactacaagaccattgttttcattcaggtggttctctctgatgtatgggatcagacaaccgtcattttgcggagtagtagattgttgttataactacttccgtcctgcttctgcaaacggggtctgctgtttgggcgagttccatcagggttgatcgaaacagcaatatcattatcgatactctaccagaatcccattgatcaacttcacaacactgataatcaccagaaatcatatcgtatcaaaccaccaacctcaccaactgctcatcggtcgcgattccgattgtcacttaactcgtaacattggtgaaagcttcctaagttccgcctccaaagcgccaaacagaccatatggcgaccatctggccgttgttttccactccgaatctccatgtcactctcagcacgacaaaaagatatcccttacgatgaattgaacaaaaaacaatgtccgccacttttctgcggcccagcaggatcgaactgacaatctcttaaaaggccttttttacttcttatcggtatccttatcggaactctaagttgatgataacctttgctggagaacaaagaccattaaacaagataccatctctcaagagcaagataccaaatctcaaacacaagatacaaaaaacccccatttttgcggttgatatccaaagcaaaaataccgactacactcaactcgcttcacgtgacctgaaaagtacagccccgtaaaacggacccgttacgaaaataaagtttagtctatatcaacctctaaaagtcagtcgagacgcaactcactcttgtcgactccattgacccagcacaagaacggcggaaaaagatcaccaccaaaagtggctgtcacgtgacattatcctccgccaacaactccacacaacaatctccgatattctccaatatgcacgctttgctcacctgctatgtcatgcactactctgtacataatccatctctatgtacggggagatgaggcacagtcccaaatgggttgtccgaaattgttttgggaaatcgtttttcgaaggggttttcctaaaaaaggacgcgataaatgcttcgtgaccacgtttctgtcttcatctcccttccacctccacaatgttcttttcgactgcgctcttccaacaccaaccagggctgtctacggtatggcttctagccacggtcaacaagtcgctccatcgtcgagaagtgatggagctacaaatcaaccacatttgcaaggaaatctcgtctccagctcatcccatggcgttacgactgtcttcacagctcatgtacggcacagttgtggccatgcatcgccagtcctcctcgctacaagcagacgcaatcaacttgcgcaacagactcagctttgctcctctggctcccagatcaattgaccttccccagagacgtcctgcccgtcagtcgctggttctggaggacgcggcagttctggcccctccgcctctgcctgagattgcaggggtgccgatttcaggtctctcggaactcaacctgcccgagctcattacacctgaaatatcttgggcgttcgacgacgatgatgagctcggtgatctggacatgtccttcgacgacaacggcttgctgaccgacaatctcaacattgacgactttgtggtagacgatgagctaaacattgatctcagctccgactacgttcctccaagcgacccaggagtcatgactcctcggacccctcgttctccccacacccccctgcacagctccccgttcatgcgccatgaaatcatgcaagttgacgacctggccacaatccaggaagccacacagaccccggctgggtctcgaagaaaacgagtaagggcagctgtcatggacgaggaaatatcgctcaagatggcagatatccgcagcttcagagacaattacctggaaaacatggagttacagaagcaagacaggcggcctcgacgcaagcgacgaaagggcaagtttgggcaatggaaggagtccgttttgaaccaatgcgagagtgatccaatcttactgctcgaagacgagatccgagagatgcttaccgaacctgtcgctccccgacgtcccaccagaccgagtgctgacgttcctgtcgagctggaaacaggtagagcaggtacttctgcacaaaacacccctgcaagcattgaaattgcacgacgaggctctgctgccacatctccttggagtgaccaaggagaagctcgaattctggggacatcgggcttatttggttctcgaatgagtgggtcagccggcggcacccccgggtcaggaagagctcgtcatagtcgtcgaggaggcgtgcactctagatcaggatcgtttggcgacattgatttcctcgacgagtatcccgacccctattttccagacgatattcctggcgatgacgagtacaacatgttgtctggaacgtctattgctgctcacgaggcccaagagttcctgtttcatctaatgagtgtatgtcagggaaagacgtcgttcgaggcaattcttccctctacttcatcggatggtgtccctaacgatcgggctactgctgccacttcgtttgccaaggccttagatcttgccacaaaggggatcatcaagctaagcggaggaggcaagccgcaaaatgtgtttgtggaattgacatgagggtttatagtgtttgattatatctggattaatgctgttggtgtatgtgggtgattgctgcagcttggtttatcctggtcatttcgttgtcctttcagaaaactccatgaatgggttgccactttaccactaacgagccaactggagaaacatctacaattattctgccgatgtttcaattctgttaacaattcgtgagtacgagtccgataactgtacaattagttgtcacttcacttaacagtgtagttggcaagctaactgtagatttctcaacaggatttggtctatactgaccgtcatacctgagcatctgcacaagagaataccaaacaagtctgctaatccgatcgggatctctttagtatcaattaaacactgttgcactgctcgatgtaccgacttctttcatctctggtcaacacatggagatgacagtcaacatctgttatgatgtcgccatcaatgcccgcaatcgactctcgacagtctccaatgtttgagggcatggcatacttagttgaagaactgattatgtggagtatactacacaattgaaggaggtgatggaactagtactgcacgtaaacacatccaccctccggcaccccaactagaaacctagaccatgatgtacacaatgccatagggatgaataggctgccatggggacgaaaaagaccactcttctaatgactttgatcaacagcaactactgtacatacggtactgtactctacctttactgcagtagctaccaccacctctgtctgatgcagatggtactcaatcctcgtctcgagcgagaccaggaaacacccaaatccgactacattatcctttaacatcacagatccactcacttactcttactcgtacttccacttctagtgggcgcatcccttacatgccgatctacatgtcttgaaatatcgatggacatgtaccttcagtcaagagatcaccctgaagcagaatggtcatcatccagatctacgccctggcgacacggtaatctggtagcctccggttcgcctcccagttcgacactgctagccacccacctatctcgacgcgactgatctacaccgcggccatgatgtgtcgtcgtgattgagtttcgcagtcgtgtttccgtgcagcagccaagatgcgtttgggtttcggctaaggagacagatctacacaaacactcggtattggcaatgatctacataccaacgagatcctggatgtgatatataagcgtctcgacgcaccgaagggcttggcgttgtttttttggacgttgccgttgtttttttttggacgttgccgattttttgtcatttccgctgagaccctgtcgccatgaaaccagtcgcacttctcacatcctgtgtggctacatttgccgtgcttaatggagccattgcggccccttcagcccccaaagtgctccagatccccgtcacaaagcaccacgagtctgctgctgaggtcaaccggaccctcgctctagctcgtcgagacggagcgtacaccgaaacggtccacaacaaggagttctggtactccatctccatctcgctaggaacaccggcccaacagttcaacgtgttgctggacacgggctcgtcagacctgtgggtgttcagcacggaagactcgaccgactgcgctaacggagcctgcgaattcacaggccagttcaacgcaaagtcgtcttctacctaccactacctcaacagcgactacagcatcacgtacgtgacggggtcggctcatggagactgggtcacggactcgctttcggtcggccccgtgactctcagcaactttcagtttgccgtggccgacaaggcggtgggcaatactgccatcttcggtatctctctggagggatccgagtctctgaaccatggacaacagcccgagtatcccaactttcccgtccagctcaagaaccagggcttcatcgacagaatagtctactctctttacctggaagatgtcaattcgccccagggcactcttctactcggaggaatcgactacgccaagttccagggtcctctcaatgtgcttcagcttcagaacgccaacgctttccaggtcgagtaccagggagtcggaatcaacggagctgggccctacggacagcctcacgtggcggttttggactcgggaacttcatacacgtttctgcccgatgacatctactacaccatcttcgaccaggtcggactatcaagtcaagtgaaccagaacaccggtctcaactacgtcgcatgtaacacacgcgttactctggcgtttgatttcggaaatggagccatcatcaatgtcgactctagcgagctggttctcaagctgagcgacattcttggtgatccccacaacaaccagtgcgtctttggagtctcatccaatgacaacacccacggtatcacccttttgggagacacctttctgcgatctgcatatgtggtttacgacattgaaaacaaggaggttggtattgctcaggcagtgtataccagcaactccaacgttcagcccgtcacaggtgctcttggaggacagggtcagcagcagagtcaaggtcaaggtcaaggtcaaggtcagggacagcagagtcaaggccagggtcagggacaatatccctgggatggacaaccttttggatcaggtttcttctaattttgaagcaccaactcctgtacttttattcatctagtccacggaatcgtagtacagtacagtaattgtcactgtagcagagctcaatcgtgctgctaaatccccaactgagcactcgctttccttctcgtgtagtcaacaacacctgaacacatacaccaggattgaaacttgccatctcgataccctaaaaaatggactgatggttcaggccatgccatttgagtcttaaccagagtgatgataccggtagcaagatccacaatctcctggccgtatttgtgttctgtggcgaccaaatggctcgaatcacgtgtgtcactgccttgtgcaaagacatttttctttgagaagcccgtgatagcaccatcggcattataatacaccttttctggcgtttcgaggtcgatgaatgtcggaacgagacttgtatctcccactgtccaccaaacgagtccgttgtaaaaggcctgtggccgtgctctgagtgctttggcatatcgcaccatttttcttccctccaagtcggccaagttgaagtagaatccctctctagacacatacatgttgccaaagtggtaatgtgagtcttgtctggtgtaccaaaagtagtcctgatggtgcgcaagatcccggggaaacataagaacgtgatcggtcaccatgtacaccgacaccatcgttcttccaatgtaaatgtcctcaatacagtcttcatcgtcgataagccaagtgggtagggtaataacgatatcgcgaaacctcaaagttgaaattgtttcacccaccgagacgacttcataaggctcctcatatcttctcgattccattgtccagggatccactactagcctagcttggtcattatcgatatgcacatgttcacaagttgaaatgccgcatccacagtcgtccagaatcgatgtgaagtctgacggcagattttcgtcttcgaaaagttctaaactcaccatcgttttcctcggtgcgtttggtttcgtcaccttgatggtgtcaatgttgtctgtagtgtgccacttgtcgcttttcagtcgacccactaagaggagggcgcaatcttgccaggtcttcatctctccatctccaggcttcatccaggggtttcgttgtctcagctttgttctcaaaatgctatcagactgttggaagatggtgtaccattttgacgacacttgtcgtatagcaacacatgtctccaggtctacgcgagcatagatcattgtcataatctctggaggaagaaacctcgtctcggttggacgagaagctatatctttgagtacaacttgcggtttcgtacttgtgactggagaaatgtgctcgccaaacttgctctggtacttttggaagaaccagttcttgagctcttcactctggttcctgacaatgttttggagacctccctgaaacatgacgctctccaaggattcccaggtctgctcaaactccttcatgagcccctcccacacgagacacttctccgacaatcccagcagtatgccgatgagatactgctgctgggccccttcgtagtccttgggcctgaccagattccggaaacctcgcacgtactccatttgccgctgttggtttagcacgagcgaaccgtgcgccggtgtgagtctctccattatcgcggcacattctctcgccagatcgtccacaaccgcgctgacttgttccttgctggcggcaacaggaacaccgctcatctgtatttccccatgctcgtctttcacaaagtcatgaaactgaaagaactggaggtacagcttgtggccggtttccatgcgctttaaccactccgattctatgctctgcctgaggtcatcccattgtctatcacattcttcgcgggtatccatgatgaggaaataggaggagataagcagaggagagtaggtgaggaagagagcaggagggagaggttttctttcagttcgatcattatctcggagtccatttaatcttaactttacacgcgactgaaatttggaatttgaaatttgacatttgaaatttgatctttgaaagttgagaggatacggagatcactggagtacggatacaagcgatatatcaatggtgtcgaattgtcatggttgaactcagagatttttgttgacttttgttctatttgatcaagcacaaatgtcagttttggtagtggttgggttgtaatggtatcgcacagtatcctaggggagcgttgttgacctgctttgatgacctgtaccaatctcatcctcactctcattatcaatcaactttctcactggcgatgtgcagtattgcacccttctcgaatctcaccagctcttctcagctcttctcagctcttctcagctcttctcacccactctcatcacgtccaagggtgccgaaagtttcttacaatcacccttcaatagatataatacaatatatacaaaaaccaatgtctacctcctcctcataaataatcacccggatcatcacatgtatgtcccctttgtctcgtcgtgctccagtttgatcttctgattcatgtggttcccatatcccacgtgttctggctcgagcaggtcgaaatcgcagctgtaactgacctccatcatgtcgtccagttcctcagcctcccgttgaatctgctccttgacagccgtaatggaatcactgccaatcacaaaccgatgcggaggattggggttgcacgctatggagatgactccatggacaatgtcggtgatcgcttgctgtggataaatgtcttcgcgaactataatgttacgcaatcgcgtaacatgttccgacgtctgctcatcttcggtcataaccaccccctgtgtgaaaagagacgcttcaagaggagcaataatgtttgtgattttgatgccgaatcgcgacacttctaacgccagcgattcacaaaagccgctcagagcccgattggcggcacacagcaacgacagacctgggatggctaaactggcggtggagtccatgatgttgatgatatggccctgaagctggcgccgaaagtgcggcagaatcgccttgatgacgttcacgtgatggaagaagttgctctcaaactgctcgttcacctgccagttctcgtaccgcgacgcttctcccagaaccatggtgtgactgcagttgaccagcacgtctactgtggggcgtcggttgaaggcatcggaaaaggccatttggcacgaggtcgagttggccgggtcaatttcgacgaacgacagagagttgttggagccgtgtttactcagcagaagttgcaggttgtcttgagatgtggtttcccccacctccagattgcccagacccttgttgattcctccgatcaccacgttgttgtcatgtagtacgcgctgtgcaatttcgacgcccacctgcgtgtttatgttgcagataaaccacacgtgcgccttgggcccgttgtctacctttttcatcgggtggtatcggagtgatgagatcaagtgtgtagatcaagtgtggagatcgaaaatgtggggtccgaactttgtccgggttgcattgttgagccgcagggtcgtagagatgagatgagatggatgacatgtgaaccaaaaacatatcaccgcgtcatgaaaagggccgttaaacggagtctgaaggtcacaaagcaggaaattagacataatgtacattgtcacgtgattccctgcaatccagtctttattggtctacgaacatgcggttttctgctctgggtgagctgtctgctcttaaccaacgtctaagtaaactagagcatagtgttaactgtgggttagaggatacaaatgtgttcagctaaatgagataaatataaaccttttcttaactaattatcaacaaaacaacagggaggatcgcaacggaccatcacaagacgtaacacaagtaacacaagtaacagtgccaatgcttcatctacaattataggcgtttagaggtgtacgataaagtccctatgtaggtctggacagattcccatggatctcaagacataccaacctgcctcatattcgtcaatttttcaattactgtatatacgtgttgaaaacgatctgagagaaacacgtgcattggaaacacacagcactggaagcacttattctatgatctgatgacgccttttctctgatgacgcttcttctctgccaatgtccgcactctcttaaacctccaactccatagagtccttaataacaccgatggcagcactggtctggatcttctcggagcctccgttggccaaccggtactcaatgtcggcaagcttggacaagagtgcaatcttggtcttctccttcagattgagtgccatcagttcggcagacagcttctccagaatgtccaccagtgccagacctcgttctcgtttcagagtggaaacggtgtcgtaagctgtggtccagtcgtcgttcaggatcgaagtcagaatcgtgtcaatgtctgctgggtcaggcgacccaacacacaagtatacttgtgaaagagtgattgtgtcctttccagggtgctccagacccgtgtggcacgcctgcagcacgttgagagcccgtctcatgtctcccttggacagctccagcagcgctgccttggcgtcgggcgcaatcttgaccttttccgcgtcaatgacctgcatgattcgtttgtcgatggctgcctcgggcaaagggctgaatcggaaccgtgtgcatcgcgatagcagcgcggggttcagcttgtgtgtgtagttggcgagaatgcaaaatcgggtatgggtggtgtactgctcaatgactcgtcgcagggcgttctgagccacgttggtcatagcatctgcctcgtccagaatgaccagtttgaagttggatcgcgcattctcttcgccaccacgctggaaaatctgccgcgagctggcaaacaccttgatctggtctcgcaccacgtcgattcctctgtcgtcggacgcgttgagctccagcaccatgctcttgtagctgggtccgtagatctctcgcgccaccgcaagaatggtggacgtttttccggtaccgggaggaccgtaaaacagcagatgcgggaactttttgttggccagcaactttttgagcgtggtcactactccctcgtggcctgtaacatcgtccagagtgtcgggtcggtacttttcgacccagggcagatgatcctttccgggcttgatggtgtcgacagcaatttccttgccctttcgcgattcctcgaatccctccatgttagcggacattttctgtgtgtgtagtagtgttgatctgtgtgtgctggacgcgtttcaatttgaagttttacatgcatgtggtgtttttctttcttataatatttttaagccggctgtgagtaaacgtcaagtaggtactgcaggtgtcgttgggaaatagttgagtatccttaacactggtcgaagttttaaaaccgaatagagacgacgggaatagtcgaaaaatataggagaaacatgacgaatcgaaatactttcaataaataacagatatttgtctcatccctcacaatctgtgtctcaactctcaccatatccgccccattggtcgagataaacgcctacccttttttttttattctcgcccaccatcagagacaatcaaggttatcgaaatattgtgacgtcattgggtcggtaaagcgcgaatatcggggaccgaaacggcgtagaaaggtgtcaaaaacttgtaacggagactctagttgctccatctaacagctatctctcccgaactcctactatcatcgcgtcgtctactcgtcaaactaccgctgcacactctgttcccccagtatttttcatttttcagtcggaacaccacgtgcggcttaaaaacggttgttggacaaactcttttttttcaaggagagatggtaagacatgaagaagacagtacaagttggcgttgagaatacgaccttgtgcatcgaatcgtccgcacgctcagtggcgcgcctgcttgagtaaaaaacacctcgtctttaccacgtgatcgggcagctttgggtccgcctgtgtagagttacgtagttagcatccccagtgttgtacagcccggcacgtgatgtgcacgtaggctaccttgcacctttcaggctcttctccaccacccagcatgcgtctgtggatcctaattctggggttggcggtcacgttggtccgggcgtttctgggcaacgtgaccgacgacgactcgctcggcacgcccgagctgctcctgccgttccagcatctcggcaacgacctgtggagacgggtggtcgagaaccgggccaaggctccgagctcggtgatgacgaccacctcgagtactacgacgcacacagagtccacaaatctgttcacggcgtcaacagtgcccaattacaaccagccgaccggcaccacgccggtggtggccactcccatcgccaacaaccagcccgtggactacgtgatgaaactgaacgatacacgtatctacaatctgacggacattcctgccaacgccaagacgatttacatcaccgccaacatctgtgccggtccacctaacctcaactacaaaaacatgtccatggactacgactacacagcccctgcattactcaaggctggatggaacccgcagaacattgtcttttccatggacaacttcgagtttggattcgccaacttgacgattgatgttagcgcggtgcaggtgacgaacctctacattcagctggatttcagcaacatgacgttcgacaccagtgcactgaccaagatcgactcagatgtcaacaatgtcgacaaacgtcaagtaaaacacgcagagctcaagaaggacaagctcaccaagcggaaggacaaggatgaggacaaggatgaggacaaggcgccccaaggaggctcggacgatggagatgaggtggttactgctgcccccagcgatgtttctaataacggagtatccaaacctgcggctcccacgtcggtcgcaggacaggccactcagcctggagacttcacatactcgctgggggtttcatgggaagcgcctctctattccttcaaggacacaccgaacctctatctggtcgactccgactacaaccatgcattatttgtgacgggcaacctgacaaccgatccccagaacgccacatcggaccattacattgttgatatcaaaaacgccatctacgacattactgcgttccccatggagaacgaaatgcagctgtggtggctctccaactcgtattgtgccatccaaaagggcccatctgtgctcaactcgggtaactgcgatgtttcgtacacccggcgaggtctcggacattactacaagcagcaatttttcatgaaggggctgaacaactctaccccctaccttgctgtgctaaccaaacccaactcaaacacgccaggaggcaccgtttacgaccaagtgtggttctcctccaagacatcagacaattgccagctggtctacgatttggacttttgctctgatgtggcgtacgcggttccaggaaactcgtccatggtggactcacaggaactagctaaattatacgacgataacgcctccaaatggtggcaaaacttcacctactcacaacagattgtcgcctgtaacgcgtcgctggactcgagatactccattctcaagtcgtgcgacgactgtgctgactcatacaagcagtggctttgtgccgtgaccattcctcggtgtgcggactggtccaacaacgcaacctatttacaagaacggcctcctggcacttcacgaaacgccctcattgatcgcgttctcaagcccggacggtacaaggagatcctgccgtgtctggacctttgtcagaagattgtgcaggactgtgacgcttctttgggcttccagtgtcccaaacagcatcgaaatagagagctcagttacgggctgcgatcagacgacggagatatcacatgctcgtatcttggagcagtctactttctggacggcgcgcgagcagtgacgctgtccgtcgccctgatggcagtgtcgttcctgtttgtggtcttgtggtagcatagatttatagatggagttcaagacttccaggcaatacatttagatatatggtgtgggcgacaatgtagagcaggacaaacgagccaaagggccgctgcacgagtccgcctgggaagctaccgtttgtcggagattgagaaagctgttcaggataccttagcgagttcttaggaacactatgtgctatacatacgatagctacagtctactatacagcgactcgattctgtacagcgactcgacttgattccgtaaagcgactcgcttcgttcacagatccaagacggaaaacgatttcagatacttttatacgacggtggagtacaagtatatgtgctggaacatttctactcaccggagtgcaaccaatctgtagacaatgttcatcttcgagtgcagtattcgttcccagtgtatgtacatactgtacactgtaggtacagtgcctacttgtacaggccgccgtaccacagtgtacaacctgtaagacgctgtacgtagtccaatactcgaattctatatcacatagacattgaccaccaatccttgctccatctccttctcatcttagacttaatctcagtggataccaagcaagctattgctgtatctgacagacacagcaatagctcatctcctgcaatatttctgtgaccaactgtgccgatctgctctcaatcccccctctaatacaccgataccaccatatctacgcctcgccaccaaaaaagatcaacatataggcccccttgaagttgctcgatttgccaccctaaatgcagtcccagcccattttctcccatttctggcctaaattatccaaactcaaaataatacgaaagctgcataaccaccgataatctatctcgccccacacaactaacacatctacaccttccacgacatgctgcgactcacacgagccttttccacctcgctacgacgggccaatcaccagttcggatcgctcggacccatgtcggcgcctcccagactacccaaggagcaacaggaggagtttgaacgtctccagaaggcggcaagcacctcttcggcgtttgccgatcttatgactgacgaggacaaggccgctctggacgccgacatcggacccacgctttcgtccaagggccctgaactcatgcatcccgaacagcgacgacgatacgacgagtttgagggagatcgaaaccccaagactggcgagatcggaggccccaagcaggaccctcttaagcatggagattactccttcaacggacgatgcacggatttttaaagaacatctagtgctaaagcaactgccagcaacgctctcaccagcaacaaattgtgtattcaatagattttatttcatatcactaagtacagtagttacttaacaaaagctaaataatcaaaccggacttacttgcactcgtacttacacctctatccgttccactctcaaacccgttacattacacacaataaaattattcattacttttcctccttggccttcagaaccgccagcagagtctgactcttgtgcaacaactgctcgagctttttcttggtctgctcggctaccctatcctcctcctccagcatgaaactcgttcgagatagctcagcccgagtaataccctggatcgcatccacagagttggacgacgtgttagcgtctctggtgaagctggctatctgcttcgcctgagtctgcgcctgcttggtctgcttctcaaactcgggcagcttgttcttgagccggttcaattcgacatgccacttgcgctcggcatccgacagaggcagcgactgtgatcggttcaagtcggtcagcaacttgtcgaacctcttctcatgatccttctgacgcgcaatgagcttcttgagagactcaagcatgtctgtatcaccataatgcttatacagcttctcaaaccgagatttgacagcctccaagtcaaccagttgccgtcgcaactcactcttctgcatagttaggcgtctctccatcaggatggtgacctcctccatcttcagattttctctcgagaaatggttagcaatctgagtgaacacctggaccatgtcaggatgctcgcgcaacttctccgacatggagaaggataaattctcaggtagatcgggcctaatcttgacagagttgatcttgtggatgatctccggtgagacagcactgatcagaccagctcgcttgacgtgatcagccgcgacattaacattaagttcaggaatagaagatgccttctccaactcagtagccgaaagagaaagatcaccgttctcggaaacagacaaatcacactcgtaaacctggtctgacacaaggatgagacgctctgtgaatgtagagacgccgtagtcgggtgcaagagaaatgcgcacacgtgacgagcgtagtttggtgttttgaagctggcttaacacctgcatgtcctgctcgacgtaagctccagcaagctttctataccagtttcgagtatcgacctgagtgacggaatcagacgctaacacatgaacaaggccatcgtgaagacactgagacagaacagcagcactcttcagatcaatagtctcaagaagaaccatctcccgaaggccaagcgcgttggaaccgtcttcctcctcctcctcctcgtcaacccaaatgtgatcaggtgaatcccacgaacacacaacagggcctccagcgtacataagaatgttgactctgccagactcaaagagctctgcaaaaagggcgattccacgtgacttgagagcaaccagttgcttggcagtctccgtgtacatctccttggggtagggagacaccacaaagggaccttgaaacttgagcttgccgtttccaaacggagctttgggtttggtaaccttcagagctaccacatttccgtgtcgcacatccttgttggccaagggaatctgtctccataggtcataacaccagaccaggttgcccttgaacatcttggcagtggtgacacccggaggaggcagacccgaagaaaccttggtggtttgctcaaggtaaacagcctggtccaagatgctcttgatctcagtctcggttagaagagcggaggaaggcatccaaggggagagacagaagatgtcgccatcctcgttgagcagatacagagtcaggagacccatggccgcggacgaatggccaaatgagaaggaaattacctcaccaatggtgtcgattcggtcatcctcctcagcaagctcgaaaacggacttctcaatgttgctctccagcgagacaccaagagaaatgacctgattatcgccggtaagaatctcaagagtagcatcagggtctgcgacagggttccacagaacataacggacacacgaggccgaaatgtgcttggaaacatcttgaacggaagatttggcgatgtcggagtcgttaattcgaacaacagagacgttcttttcaccaacaacagccagcagagtgcccgaggggttcagcagaatgttggagatcgcgaatccaaccgagacaatcttctcacgtgtttgagcaccagtgatatagctgtaatagagagtatcgttgatggctgtgaaaagaaggtttcgcttgagagcagttcgttgaccaggggtggtgaaagaggcattgggtgtcgacaaactggacttctggggggcgttagatgcagtggagaaacctggaggggcagatccggcccggtcgctagacttgggagcaccaagtccgctggagccaaagccgccagtcttggaggcaggagcaggagagaaaggggctccgaaaccgaatcccccagtcttcagaggaggcgcagcagaagaggtggcaccaagtccagatccaaatcctccaggtgaaggcttgggggcgtcagatgacgacttggctccaaatagcgaagaggtagtgttgttacctgtgccagaaccaagactgaacggtttggtctccgtcttagcatcaagattgaaagagggagcagctgtcttaccagcgtcgggcttggcattaagattaaacgacggagtggcggtcttgtcttcgggcttggaagaaaagcttacgacgggcttggggtcggccttggatccaaaagtgaaaccgccagacttgttatcggtctgggttccgatagagaacaatggggccgcaggtttgtcgtcctccttcttagctccaaaggagaaagacgctgtagcaggcttgtcgtcctccttcttcggaggaagagaaaaggaaggacccgtgggcttcgtctcgtccttctgggcaccgagagagaaaggggtggcagtctttgtgtcgtccttcttagcacccaggttaaaagtgggagcagaagatgaagtaggggcattggcaccaaaagaaagcgctggtttggagtcagtcatcttttcgtccgcattcttagtaccaccagaagacagaggaggcttgtcctccttcttgtcatcctccttcttagcaccgaaggagaacgcagaaggcttatcctctgttttggctccaaacgacaacgcgggcttcccgtccttcttatcctcattcttgacaccaaatgagaaagcaggcttctcgtcctgcttttcaccctccttcttggtaccgaatgacaacgcgggcttctcgtccttctttacatcctccttcttgacaccaaatgagaaagcaggcttatcgtcctttttgtcctcctttacatccaaagacggagccgtcttgtcttcattcttgacaccaaacgaaaaagcagagggcttatcatctttcttggccttctccggcttagtctccttgtcgtccttcttgtcctcgggcttggaaccgaatgctccaaaggacaacgtgggctttgaatcgtcctttcccttttccttctccttctcggctgcaaagctgaagctgccagtagcaacaccagaggaagatccaattccagagctagaagtgccaaatccagagggagagccaaatccaccagacgacagcttggggaatcctccagtagcaggcttgtcgatgctggacgaactgaacagagagggcttctcatcgtccttcttgtcatttcccttgtcgttgtctttcttggttccaaatgagaatccagaaggcttgtccttactgtcctcagtcttgtcctccttcttcacaccaaaaccagtgaaagccggcttgtcggactgatctcccaaattgaaccctccaaacgtaggcttgtcggtgctagacttgtggaccgaatccttgggcgtatcgaacagagaggccttgggcttggccggggtgtcaaacaggcttggttttgtgtccttcttgtcggagtcgccatccttgggctccgcgggtttggcgaacgagaatccgccgctcccgaaggccggtttggcctctgtgtctgttgtttttgtgtgtgtattgtccgagtttgagtcttccttcatgtcgtcagacttggcggtagtggcaccaaagttgaattgcggcttctgaccaaatgcgaaggtcggcgccgctcctttctggggcttttcgccgtcaccagcgttcgaattggacatgtcgatggaatgtgacgaggtagcactgtcgatgttttgaacttgatttttggggccctgcattacgaggttattttcctgtatgcatcttactgccaactgaaagagcattgtagatcgctacgagtgcgagtccaagggccaaaatgactgacataaatctgaaaaaaaaagtctcaattcgttcctggaccgccccccaacttgccccatgcgatgtaattgaacctctcggcgccgtctaatcgcagcaacgtgcaagtccaaccaccccccaccgtctaaagaagcaactacaagaccctggataatgatgtcttcaaaaagctcccaaaatcgcataatttgcgtatatatatactccatactgtaatatacgactgtaaaaacgataatgggtactttgctgcagttacagttccaacactgcctctttgtcgaccttttgcagccccgttggtgtcctactactcaaatatattttttcaaatatttagttgacttaatttctcttctccaactaaagctaaccaattagcctcccaaaagagccttcttcaagtactgcacggtacttttcctacatcaaaaattctgcactcccgtcaacaaagtttcagactatcgtgatctttttttcgaaatgaaattcagctaattcacacacatggagctcacagacgaactggcggcaatctccatcgacacagagccccgcaaggtgctcaacgaggcgcccaaaaagggcaagggcaaagtccgaaagggacagagcgcggaggagtaccagagacaggtggatctgtacacctcggggcctcccgttcagaccttgacagtgagtacctccacagctcaccaaatcacttacattggttccttccactaacacagtcaatcctggaaagagactacagcaacatcgacggcatggaccgactcgacagacatgctgtacgacatgctgcggaacgggcttacttcctgaaaaagtacgcggaatgtatcaaggtggtggacgacagcaagttgctggagagtcccgaagtggaaaagaaacacgcccgagacgtttacgagattcgtgtggtctacgactcggccaagtctcttgtataaatatttattaatgctatccctattcaacaacacaacgctagtgatccgtggttccatcactgatccctttgatatacgcgcacctcaatggtactgattatccgctgttgtttgacaatctcctcatcgctgtccgactcgtcgtctccatccacctccatcttctctgacgtctcgtgagccaccttgatctcatcaaacagagtcgtttggcccgtgaagatatccaccttgtatccctctttctgaaagcgcagccccaggctgatggtcttgtccacgcactttcccatgcccatcattcgaatgtactggcgcctgggctgcttgcgactgggttttagcagcttggtcaccttcttgagagcagacacaaaggccattttgctggacacatagaaacagtcctgcgacgcctttccaaccagtctgatcggcgcatgcttcactatcgttccctccacccgagttcgcttttgtgccgctggtgccattgttgtgtcagagattgaattataaatttcagcagattatgcaggtgtcgataattgtattagtcagctgagcagggcccaagcaaggcgcgaagttgcatcagttcaacatatacaagcggtttttacaggtcaaggagatgtatgagccgaaagcaatgttatgaccctcttttaagagagattttcgttcccacaatggagatatagcagagtcgatccggacgagttataatagccaaaatcaggtgaactttgatagggcaatttcggcttggaaaggatccaccgtggtatgatgatatcgtaatatcgtagctaccgtattgaatagtgcgaacagtacgaacagtactcgtagttaggtgaaaacggagagctattagcctggtacagtacctacctacagttcatactgcacctacaacacactgtagatccgtactgggagcactgtatgtactgggactgtacgatatgagaaccagcaaagaagttccattgcggtattagtggtatattccaactgcttactaatataaatgtccccttgatcctgtcttcgctattcattaaacattttctatcaatacacacctctgctatacactcgtgatatggacccctaccccaattacctaactcttatcaggcatgaagtttggtggacagagtttggttttaacatcaatgaaacgagggattgaacgacacgtgggcaagttctacacgcgcaaaatcgcggcgaaaaacatcaaggtcgagcggcggcagtcctccaacgacggcgaggccatccagcgctttttcgagcagcagcagcaggttcttctggcgcagacgaaaatcattgctctggacggaggcgcagtgaccgtgcccgaggaggagctctatcgcatggtggagacattctgtcggcatggcaagggcgcgcaatgctggcagtcgctgttcaaggagtgtatcgagccgctgacgacaaagtgtttggagaacattgaagccatcagccaggccgggctcaaatcgatcaccgcagcttttctggacgagtacgacatgtggagaagccgcattctcaagctgcaactcatctatttctacctggaccgcagtttcctgcttcagagtggcaatggggggagcgacattctccggagatgtcaggatctcgtccgagacaggatttacgcagtcattagccagcgggtggagacagatttcgcttctatcttcgccaatctggttcgtggagcttctgattcggcattgctgcttcagcagtgcgagaatgtggttcgagagctctgtggagagtccagtgagcaatatcagcgcattatcaaaacggtggcggtgcagagtcggctctacttcaagttgcaggctgaaaagtggcagattatgagccccgttcaatatcttcagctggtggttgatacccaagtcacagagcatagacgcattcaggagctgataaaggactcatctcgggttgaaatgatcatgtctgcccttcccgaagagatgatcgttccgcatgtccagttcattcgcagaggagtgactgagtcgtttgaagatgaactcatgttcccttacattcgtcagctgtcgttgttgtcgttcgagggctctgagcagcagctcagaatcggtgacatctttcgccaatggatcgaaactgtcctgggacccacttttacaaatatcgacattgtcgtgcagtcgtaccacaaaagtagtcgagtcactgaggcactggcagacgcagatctcatcaacaaggcaccggactgggtggcagggttcagaaacagcatgaggggtaagagaaacctatctgaacagctggccaaattctccgactcgctactacgaaaaggagctaaaggaggagacagcttgaagaatacggctgatgttaaaacactcacatttctgctctcgtgcatccccgagaaggacgtgtttgaagtctactacaagcgatacctcagtaaacgtctgctggtgggtcgagcacttggtctagaaagtgaaagcgaactgttgaccattctacgagacgagtttggacctgagttgacagaatccatggaaacaatgctcaaggatgtgcgaaccaactcgcccgctaccatggcgcaatatcgcgactctgagatatacacaaagtacggcaacttcgacctgaatgtcaacatgttgagtcaaaacgcatggccgcaatttccggcttccacatcacccatccggctaccgtcgcaaatgtactcgcagctagacaacttttccaagtttctcagccaagatcccaagaacacaaagaagaaagttacctggcaacacgctctgtcctcgtgtacaatcagagcacatctcaacgaagacaccaaggagtttgacgtgtctctgcatcaggcgctagtgatgatgcagtttgtggatgagaagaaaagaccgcacatgaccttcgcggacctcctggctgctacaggtatttctgagagagagttgaccatgtctctacactccctcatgacgccgaaggtgaagattctcatcaaagaagaaggggatgagacacggtacaagtttaactggaattttagctcgaaactacgacgagtaaaggtgccttccgtcgccagaggagcagacgatatcatgttaccccataaagccattcaggacactttggagagagataggaacatggagatccaggctgtcattatccgaatcatgaaagccaggcggactgtgggacatgcagaactcgtgatggaggtgttggataaaacgaaatcacgaggcattctagaggtggcggacgtgaaaaagaatatcagtaaactcattactgacgacttcatttcccgccaaggacgagatgtttacgattatgtagcgtaatatttataagccgatggctatacaaaactcatcagtgaggcttgttggatacggcttttacgctgcatttctacgggacaacatttcataactggtaacactgcttgtagccagcctaattcattatataatagagtgaatatccttcgcgactactccgcatcaaaaatgacataggcgttcaccagaatagtctcaatgactcggccctggaagcccatctcggccacattgccgtagtccgtgttcatcaacgtaggaccccagacaatgcccaggtttaccaccgacattcggttgattgcctcgcgctcctggattcggtacaggtggaaaatcaggtaccgcaaagttgtgtagttagcgtcgggaagcttgttgacggttccatggagcgcgtctcgtcgttgtatcgcgttttcaatcatggcgccatcaatgaactcctgatgcaactccttggttagtagacagtcgggcagctctcggaagtaaagctttagggcagaagccaccgaatgaatgtcgttgaggttgtctgaaggatgcagcaagtccaccttggacgggtctgtgtcaaacagatgcttgatttcttggatctgcgagttgtttccattggctcggtagataccctccacttccagaccgaaattgtcaatggcctgcacgcactggtacactgctctcggtactgttccaccctcatagtcgagaagatcctcgatgggagtgccgtagacaggcatggagtccgtcacaccaggggggaactgcgtaggcaccaccgaggaggtcaccgactgctggtccatagagattgtgggctgaatgggaggaggagctgtggtagaagaagtggaggccactcgagacgcagcgatgcctccgatcgtgccagcagctccactaggtgcaaggctggtcatagaagacgcgcctgggggctgcaacacggaattggtggttcccgaagacacgtttcgctgtcccacacctgccgaagagggagtggaagatgagaatggggaggggtttgaggagctggcaaatggggtcgggcccttgaccggcctggaaaccgaggtggtgttgttgttgctgctggagtagttgaacgacgacttggggcctgcacgcgacttgtactgaaccacatctctgttaagccgttgttttcgaggcactgccatcaccgagtcaaagaagtccttctcgttatcaatgagagcagcgttttctcgcatggaacgaacgttggtcgaggttccgggaggcttgagaggcgaaaccacaaaaccgttgttgagcgccagagtctcgcacacgtttgcgaacttttgaaattgcagtgacatgccgctatcgcactcaaaaatgagatccttgagatcccgtgatgcttcaggtcgtcgcacccgcagcagctcctgtcgcgaccgttgggcagccgacaccttttgctggtagtcctggtcggcagcctggacctttctttgtagctcctcctcgtgctggaccgaatttttggttgttttgaagccaaacttgttctttgtggggtcgccagttcgtgcccgttccagatcgtcgtacaaagactcgtacttggactttgccttctctgcagcctgctccaggtccaccaggttcttctcgtgccgcagatgcgtctccttgacctgctttcgggtcttttctgtggttcgggctagctctgatagctcgtcgttcatagcattgagctttgtgacaaatgtggcggacacatcgctaacccgctcgcccacacgtgcaatctcgtcaaactggcgatagaaggtgccctggcggtgctcgggccgtttgatggcgtcccgtgtgtttcgcgacagcttcttgagatgtgtaatgtggtcgagttctagagctcctcgctttttgatgaattgcgcaaactccttgcacgacacaatgctctgtttcgaacgggccagcagcgacgagattcccacgtccgatagcatgatttcctgcagcttggggtcctccagcaggtgggtgctcttctggggcaccacgttgaagttggaggcgttgagcgtggttcccacactggtggaggtggcagttgctgaggacgacgaaggtccagacacagagccgctgtggttggtgtttgtgtcctccacagacatgcgtgacatggccggagtcaggccctggtcctccatatcgcccacagaagacgtggacacaatggagtcgccatcattgtcgctgtcgctgtagcctgctagtgactggtgttttgtggtggtgggggtttctgtggtcgacgagttgttgctgggctcgtcgagaatcatggacggcttggaggccaggtcgtcctggtttttggggtccagacgcgattctggcatggtgataacggtggacttgcaactggtggtgttacgtgtagagtgtccttttacaaatgataaggtttgaggaggtgggtattgggacgaaacaatagtgagccgcacagctgaaaaggagatgtagaatgggattgggacgaggtatcgaggttctgaaacatgtatttttgtgagaaaatgcggttcaagagctatggacctttcaaatttcaaatttggacccccactcggccaattgaacgacctacttcaaagcggggcttggtgtaaggggtagctgtcagttcgattctgggtggggaggatataacgacaagggccaatatgggatttggcacatgaccttcggtcgtgtttttgctctagtcacgtgaccatgtaggtggctaccagttattcgacaattgtgccgtctctgtgttccgttatttgtctgtttatctgtcgccgtctaacttggcacggttgtctgtcttgattattgaaccatttggaagtaaaaatataataaaaaagtgataataataataataataataatgaataaattaattaatcactccaacaccacgattatacgagtatgagatacgagaagcgggaatgtggaacaaggacaactttgagagcctttggagggctccaaagcggcttgttttctgttgaaactcgaatctacatctcttcaaacagcaactgtggttggatgccaagtctagttatttttagccgtgggcagggtacatggatcaccacgacacacgagactgttgagacagtcaatcagggtacctagggggaaagcggtagacaagatgggttgtgaatgtctctctttgtagagtaaataaagagcagtatcgaatatctgctccagttgtttatttaccagtgctaagaggtgatatttctgtagtcttgtttctgcacgatctcgctaaaactcgtgcttttttttttttatgacgtcacggtgcgtgcacagtacagtagcgtcctaggtggtagacgctggggattgctacaagtagcaggaaaaacgtgtacactacgtaccgtgcggtgcagtatgtatagtacagtacagtactccagggtctaagtggagttctagttcgactcgtcgtcatcacaagagtaaaacgttcgcccatggctagacactccgtatgtacgttacaggtgagtgtctacgacgctcgattgtagtcaccctcatgggacggaacaccctagaattttgttttctttttgggaaaatctttctgtcgaggtcaagtaagagtggccccttctctactgttcatgagacctggcagtgtgactctgagatgtcagacgagctcagggtgtcagtttgcgttaaatccgagactggtgaacatgatttggtttggagggctcgagaaaagtctggattatgttgaatcgcaagttttcgaggttgtctagaccagatatcggctataagagctctttccggatcgtgatatcaagattgatcaatcttccataacgtagtgaactttactataatgtgaacaccaagacaattgtcaagacgaggagtttaccgttgtgtctagaaggcttccttacctcgtgtgataccctttttgacccggtatagcgacgagggctgttgtattctcaccttctggtggatggactcgaaggtttcgctgctctgagatctgactgctttgatacctgaatccttcaacaagtagaggcttcagcttccaaaaggggaaattctagtcatccacatgctctagtcatcctcatgttctagccatcctcatgttttagccatccttatgttctagccatcctcatgttcttgtctgctcatcttgtaaaggagacaactgaacagcaagtacatactgtgctcatcctatacaagtacagtatgtacagtactcgtaaaaggactgctttctcatcgtgaagagaaaatctcacctcaataattctggagcagaagtggatcacctcatctcaatcaccgccctttgttaatgttcacttctcgggagaaccctcgagaacctgcaccgtacattctggtcaagttcaccacacaagctgtgcatatgttcgtttggatgggtgtgaattgttcgccaaggagaattgttctccaagggtagaaacaggtatcgatacatagtgtagttgttccatacagaactgaacaatggcactagagtcttcggttccagacacttatcagcgtacaatgtatcggctatctgcgactcaactcttccaaacagaaacctcatttcagatgtaactattttatggctaaagaagaggactttgtattatagacctccttccattagctcctttgattcgaattatacaactttttgctcaaagatccaagtgcacctatactcctgttgttgagtacactctcattctaccagaacgtctacagtagccttacacacacccattgggatacacacatgtgttactggtgacaagtaaactgacgagaagagtcttcatctccggatttcagtcagattctctctctctctctaaacctttcgggaactgatcaaatcgttcgagagacctcaataacagcccagaactcacccaccccaaaggtcagcaatttggcatatctggcagcgtagatccacttacgcattcatactctataaacactcaacctgccatagttcccatctaagatcagccagtcaatcgtgtatgactcgctacagacgacgctagtttgagatcacgtgatcaacacaagtgccaacaatccttcaggactccattccaatctttcctctttgtttggttcgtttaattatatattttgtttcatttcgtctgtccgcgtccaccaataaacagcaaacagcctctgaatgtgtcaaaagtcacctaaaaaatccagcagcgcacatgaaaccgtgcatctcagctgtttcaccatacactgctggttggtaccacttataactctcactcaattgccactggatgtagatagatgagcggtgtggacggcgatatcggactagttcgatcctcttatatagattgtgttgagagtctgtattaaataaattttacaatttcaagtcaaccagagtgctattcatttttatttatttattattttattttcagcggttttaatcacttttcgacaattcttattttatttttattttgttgcggtttatattttgattttgatttttggccccacttgccccacttggggatttcattttaatatcgttttaaaacccaaatgaaccttcccgtagctagtgtgagtcatcttgactcagaaaaagtaggagacaacggcgaatgtggagaggaagggagcagggctgcagaggtgggaggtgtgggggtcgcgtgatccgaatggtatcacgtgacgtcgtaatctgtgtccaagacgccgtttaccgggcccgaaacgactcggtgtcgtctctttcctctctatcatctcccaaagcagccccgagttagtttatgacgtttgaggacagacgatctttgacagggtgcgtggaggagcgcggaaatagcaaagaggggtggtattggggcgttgacgacactttcaagtcagtagaagttgcctagactcacctatctccccgtatcccccccgaaacagtcgcatcgctccatctacagtgccatgtttcaatatatctcttttcgtatgcacgtccatcttcaactaactttggctcttgtcccaaccacctagttgggcctcggtcaaaccttgattccccagatcctatgtattccagatcaggtcggaaaaaagaaaccacaacaccccaacaccaacaccaacagctacagctactctacacgctcttattcacactattcatggaggcgtatcatccgggcgacctgctctcggtgatccacagcacgatggccatgatgctcatgtgtccggcgctcggcatgctctattcagggctcactccacactcttcggccctctccatggcaggcatgaatcttgcagctctatcgatggctgtattgcagtgggtggtatgggggtactcgttggctctgagtccgacggggggcaagttcatggggaatctacgacacgcaggcttccaccatgtggctctggaaccacaccccattgcttttggacggctaccaggactcgcggtggccatgtttgagggcatgtttttgtgcatcacggcggtcattatgacgggaagcatcgtggggcgaggccgtgtcgtcccctttgtggtcttcatcttttgctgggccacggtggtttactgccccattgcatgctgggtttgggggcctaatggatggagcggcaacttgggcgctcttgattttgcgggaggctcacctgttcacatcaactcgggattcacaggtttggcatacggtatcatgctcagatggagccgaggaaggaagatgggccagacccccgtggcggtccctgaaccacattatccacattcagccatgctggtaatgattggaacaggcctactgtggacggggtggctcggttttgcgtctgaaggcgcctttggggccaacctcatggctcttatggcttcgtccaatactatgattggaggagcgtttggaggactagcatgggccgtgctggactacagaatcgaacgaaagctgtcgatgattgggttctgctcaggtgccgtgtctggactcgtttctctgtccccttcgtcgggctatgtggctccttgggccgctattgtttgtgccattgtaggctccatagcctgcaacctcgccacacagctcaagtttttcatccacgtggaggaccctctggacgtgtttgctattcacggtatcggcggcatggtaggttcgctgctagtcgggctgtttgccgagaaagaagtggccaaactggacggaaacagagatatcaagggaggttgggtcaatcagcattacgcccagcttggctaccagtgcgcagaggtgttttccgtggccggatacgccttctttgtgtctcttgttctgctattcatcattgatcgaattccagggctacatctgcggatggatcctgaagcagagagccagggtcctgacaccaaccagcatggcgaggtgtgctacgagtttctggcgcagctgggtgacgaccccagccccaaccatccagacacggatccttccaacaccatcaatgggtcgtccccgcgtccttccatggacggcaaccagtttggcatctatgagttgcatgccattcagtccaaaaaggtgaacgatgcgtaccattttcccatgcacccgcccatgcaggtcaacttccctcccccggtatcccagccgcaacctccatctcaggatgcgacccctccgccccacaatgaaccacctccaacgcccatgctggactttagtcttggaccccaacagcccccaagacagccgttgaaccgcacagtgacgtctcccttgctaggggaatgaactggtgacggcgtatttatttgtacttactaattatcattaatgccgagagacgacaggagcaggagacaagagagagatgagtatcgagaggtgagacactcgaggggtgagacactcgaggggtgtatgcatgcgaatgcccgggcacgacgccagatgagtgtaatgtctcacagacgaccattggtagtatccattctgagaccctgacccaaacggtcataaaagcaccgcaacagaagttcgcagtggatgaagagtgtacataacccccagttcatggacgtcactaccccaactcatcgaggcgttaagccttttgcaattagaactattatccaaattagccagttatctggactcgcatcacccccagtttatggagtcgcgaacgttgttgcaagtcgcgataaggacgtctatataaacccgtagtccagcaccttccttcccgacatcttaacctcggacactgatctgatcatactaaggatagttgtactggagtataatctgctgcgatatatctgttcccttttctttcctgtctgacacctggattcacttttgatgacagatggtacttgtacttgtacttgtcaatttcccaaaattcgggcttgctatggacagcttttttattttattttattttattttatttatttatttaataatttatttatttttaatttttttgcattttaatttatttatttattatttattatttattattttatttatttatttatttatttatttttgcataatacatccatccatcagttaaaacttcacttgggaagaatacagctcaacctacgccaaaccacttcactgaaacgcgtctattaaacttaaagttataattaaatgaatgtatatgcagaaaaaaaaaaaaaaaacttacccgctccgaaattacttagggcgcgaccacagcctaaacccggtgactacaagtacaagtacactgcatgttccactaccgagtaccggtacagtacacaaaagatacgcgtcgaaatctgccaccgaaccagaaaagtgcgctttttccgacgtattttcggcactgggatttgagtgtcaactctgatgggcacctgtaccattaattacgcgtcctgcaaggtcacgtacgtgtgcaaacctccaccaccccagatcactaagcgaccataacagtgacgaaccaatatgtccttcgaacaggcgacggaacatccaggttcgtcttttgaccgttcgaagccaattctgtatcgactcgactacaaaatagaggcgtttgtcaatgaaggacatcgattcgttcatatccccaacgggcggaatccctacaacacactgagccatgtgtttcgacaaacagacattgatatggagcccaacatgacctttgtcgttgagaacacttacgtcgactatccttggtcaagtcagaagtgtcatcgggatttcccatgcgccctaaggccgaacgtcgttgcaccgatcccgcctcagccacctggtgctgtcgttgcaccgatcccgcctcagccgcctggtgctgtcgttgcaccgatcccgcctcggcctcctggtgctgccgctgtcacgtccagtggtctttcaagcaaccctactgaacgttccggggagtcactgaccgagaactcggggcagagctgttcctcgaaaccaggggaccttccaaaaaccacgactggaaggacaaagatgtcaaaggccaccgaacacaatcaccgagtggcgcagctactcaagcgtggcatgaggctcacgtatcctgacattacaatgacatgtcgcgaattcgactaccccaccatgtacaagcatctgttcaacgatcagatcagatcttcaagagccgcaagttggctcaatcttacgttgatgaaatcgctgccaaacatggatttgccgtcagatttaacaatggccaggggtacatggcatgtacacggaacgaagctaagcccacacggaaaaacgatacacggtgcaagggtgaatacgacgagagggtcagaaagacacgagtcacgcatacggggtgcaagttctccttagctatcaagagggcttataacgccaacgagtggtatgttgtcgatgtcagcgacgccaaacccattcacaatcatctgccatctgtctgttctgcttcaaatgctagatatcgtgctcaacagctggaggagatcagggctcagttcaagtcagttggtgctgacgagtccaaaagcgacagcgagaacgatagattggacatctgcgacattttcatggacgttcaagccgctcctcgacaactccgagaagcacttcgtatcatatctcctaaaggttacgcggtgacaagccaggacgtgtacaacctgtataaacgacgcgacaaggaccttttcggcgacatggaccctatggaggctttgctggtattgttagagaagacgcctcattttcactgcagctatcgactcgacgatgatccggctttcctcgataccgaagctgtggttggtgacctgcaagaagacaacagtgacgatgaaagtgacgatgacacggaagtacaaactgtaccaaccaagcgagctccagaacccgcgcccgtaccagcacctatcaagaagcgaagggggccaccaaagtcccagactggctcaagtcagagcgagtctgccacaaagccttcctcaccaccgcccgagggaagccctccggctgatgacgaagcaaaacgcgagaatgtcgtttgtgacatctttttcttacaccgcaagtccatcaagtttatgaggacctttcctgaggtcatcgcagtcgattgtactttcaacacaaatgggtacaactacaggctcttcaacattgtcggtgtgggatcggataataggtcgtttcccattgctcatgccttcatctcccgggagaacgctgacacctttgcttggtgtttgaacgagctgaagaagatcatggaggaatttaacattcccttcccggagtggatcctttcagactgttccaaggcttttctcaaagccaagtctcttggtggcttccccggaaaaatccgtctctgcgactggcatgctgaccaggcagtgctgaaaagggcgtccaagctctttaagagtgatactgctttcgacaagttcatggaggcctggtacttgatgaaaggtgccaacagcaagacacaattccggaaattctacagcaagttcaagaatgtgtattggaagccgggcactaccgagcccgaccagaaggactccacatctgtgggaagaaacaacagggcatacttctacatcaagagaaactggtttggcgaccccgacagcgaccacccagacaagatcaagtatcgtcacatgctcgtcaaggcttattcgaacggtacagaggatttcttcaacaaaaccacatcccgggtccagagtctccacgcactgcaaaagagcaacatgagatcgcgcatctcttctctcttctcgtctgcgatgactgtgatacgagtctcgcttgacatccttgctgacttggagaccgaacactctcaagccatggagaaatacgaagtggccttgagccgagactttaacgactgcctcatgccattcatttcagtgctggcactgcgaaaggtggctgagcaggctcagaagggtaagctcagcagtcagcaggctgaggggactggggccacgagtcgcacgagcaaatgctgtaccgagagcttcatgaatacctcgggtttgccttgtatacactacttgcgcaagattctagccaagcccaaagatggcgccaccatgagacctaatgctgaagtcaacaatgcgcccggcaagtcggaagaggagatgttatttcctgttctaatgctcggcgatttccacccacactggagaaatctacatgccacactaatgatggggcctgacgattgggatagcgcaaccaactatggcagacatcgagacttgtggcggaaattgcagtgcaggctcgaaaaggataaggaaattgacgaaatgtggcggaagaaggacgaagcaatgctacaagaagtggcatccggcaacgattttgttcgcttgaagactaagggtgatatcgctgacacgttcgttaatggcacaagaagaagcacaggccgagtgaagccttccctcgacaagggcaaggcctgccccatctgcaagaagaaagagagtggccacgccatcaccaaatcgtgcttccccaacaacgctgcgtacgagcgctacttggagaagaacgacccagagtcaagattggaacgcattgccctcgataaacgaaacttgcagaaggcgggtcttgtcgaatccgtacgcaatgcttatgtgactgcaggcgacgactccgacaacgaatttccagtattgtagtgaaatctacgtcaaactcacccaatctgtgattatcgactcaggttcgaaacttgttgaagagaactttgttaagtttctactagaagtgctcgtaatctcaggcagattgtttatgtctcacttggtcaggcggtgatactgaaaccagcgccaaaacatccacccgaaatgagagacctgacgcctgactggtgcagggaactacaatgtggaagtaaccgttctatggccctttttttcaattcacctcgtaaataattaatactgtaataattatcgcagtgctgtttaggcgtgaaaatagttcagtctattatatcataatggagtattaatcgcaccaaaagagggtatccataataaaagagtgtatatatacaaaagagtgtataataaaaaagagtgtataataaaaaagagtgtataataaaaaagagtgtataataaaaaagagtgtatcttaatatacccgctctcaccaactacaagtagtccatatattttgttttcacaataaaatattcggacgcctttgtccaatcctatatacgaccagaacatacccttcctccatccacctctgaactcctcagacccatcatcctaaccctgtaagacccctgaaacatctccacggccctaaaactgacctgccatccaccgatccgagccacagaccaattattgtgcactttgagccctacaagtagcggtgaagcctgtcggcgctattttcagctctgaactagatttcaccaagcggctcatagagttgtcaaacagagtggatcgagtcctgaatagggcgagtgcgataccagtcggagcacagtacgaatacgagcacaatacttgtctggtacaatcatggaggtcggtgggttaggtgccattgctgatgtgggtcacgtgactggtggagcgagcgccacaactactctttggtcacgtggctatcaacagcaactacactacagtaccggtactttacgcactcgtatatactgtagttacagtaacaaaactcgtatgtccacagcctcctttctcacctgctggtttactgcacggcgtgaattttaaagtcaagtcaaacgtgaaagatgcgaatggcatgtctcgtatctagctccgtatcgactccattcggaagaaaacaaggcagatggtgtgtttcagtgttactctgcattcgtcatgtttttctgccttgctccccaaccgtgatccaccctgacagccgtcgcttcccctccatccccatatatatttttagccaaaacccaaacactagatgcagtaggttatgcaaccggctctatacttgttggttggacctttgaagaccatctcacatcgctctgagccatgaaactcgcgcaatttgccgtgtggctcgcgccggcagcagccatatacttttccgactgctttcaccagcgcaacaaccccctggggctctcgtggacgccagacagcgttttcgccgactacgacaaggacgatggccgtctacacttttccgtgaccggcacggtgtcaggggcggtgctcagcgacctcaacgagacggaaaacaagtacacaacactcaacagccaatcgcgcagcatgaaggggctttttgtcgacaattatacccggttctgcgacgaggtcagcaaggacaccaagcccgaaacctgccctattcagccgggacaagaggcgtcctttgcatacacagtggaggtgcccgaggtggcgaggaggatttccgatatcgcaacgatattcaagatcatcagcccggtggacaatggagatgggctggtggtggggtgcgtggagatccagaccagtcccgtaattgataagggcacaatctacgccgtcattttctcaaccctgggcgtgagtatagttgtgtttgtggcaactttcggagtgcagtccttctcgacatggagcaggttgaacacaggctctgattcagacttggacacctcgtctccgcatgcaactatgaaggcgtcgattctggcgcagttcacgggcctggtggcgtactggcagtttgcattctttgtcgcttgtctgaatctcaactacgcaggtgcttaccaggctgtagcctctggatttggctgggccgctctcacgtttggtaagagcttcaccagcgacgtgatcgaatctgcagaccccgccaacggactctacaactttcacacgccgggaatgccagctatggcaacgatagtcggtctgcacgacaaccgggacatttggccaggcttcatcatatggtttctggtcattttcggggctaccatcatcgccatgtgcgtgtcacaatgcctggccggcagaacgagttttgcatctctattgacaggactcgctaaaactacaatcacggtggtctactcattacttgctctgcctctgctggccctcagcttctaccagcttcaggcgggaggtactctgaccgtggccaaggtgctcagtggcttgattgtcgggttttgggcactgggaggtatatacttttgctggagtgtatctcaaggacgaaatggagatttgggatgcttcacaggatgcatgaagccaagcacttcatctgcgtttcgagcatccattgtcttcgtcgaactagcccacgtctatctgctgggtgtgtgtattggcgttctgcaatcttcgggtgtggcccaggttgctttcttgggcacattggagtttctcatctttgcaatcaccttgattgttgctccttatgtgttcagtcgtctgagtgccctggttgcactgttccgaatgatcatctctctgctgtccattgtatatattcgcagtttggacacctccctttcgctgaagatcatcatgggtattgtcatcatggtgctgcatttggtggtctgtttgtcgtttttgtttttcgcaggccttttgatcttccgacctcgatttagatcccagtcttcgcctgtcagctcctcgtcttccttcaacatcaactccaagtcggtttctcccgtcaatggtgacacgcttctgggccaatacaacgacgatcttaactcgcaatccgaaaaacgagccgccatcagagaaaacatccgtttccagccggaaatgtatgaaagacccatgtctggacttcaggatcatctcaagggtcatgttcaggatgtgcaaagcccccaggatcttggtctagctgacatggactttgatttcgaagacgaacggcccatgcaccagcgacctgtttcgggccacaagagatccatgtctggaaacgaacggccactctcaggttcgctcacagggtctaggccaacgtctgatctctacgagcgaagacagtaccgacgaagacgaagttcggcgtctggccatcgcaagtcgctcaccattgatacctctgctcttgtcaaatcacatactaacccttcccctgccctgcccaacccccctgcactcaagaccgtggcagacagagtggtggcttctcctcacacatactaccgacctcctcggcgacgatcggaggatcgaacaagtactgctactcctcagactcctgaggtgcctgtgcttccttctcctcatgtggactacactcagcgagaggctgacatctacaagcgaagttctaccatgtgcgaagactacgatctgggaggtgttggcagccacgacgcgcttcacaagtcgacttcgcatctcatttccaagacccggtctgctgacgaagtgatcaacaagcatgagcgtaagttgttccagcccaagacgtggatcaaacctgaagaggatcccctcgagcccaagggctttgaggtggttggcagaggcaagtagaatcatactatgtcgctgtgctggggttattctgctgggccgttcggctggagcattggtgctcgttcagctgggcttcacaacagtggagccattaatttatttaatttaattcatctttttagtcacgctttggttgtttggtatacacgcagtacttttagaaatcaccagtgcttgaatgtctgaagactggtccgacccatgcaagaggagggataagagcatgcagatttgcgactgtctaggtgctttccggttgctgcgaatacaagtacgagtgcggttattggattggtttcgtcttctgaactctcgaatatcactcgttacaagtactgtacacttgtagtacagtatgggttctacaagtacatgttggtgtatgtacagtatgtacatactgtacttgtatttcgatatacttacactagtacatattgtactcttaccaataaatattcatcgagtcaattgcaagtactgtacatgtactgtacagtacatacttacctgtctcgaggaacactcactcgcactcatactcgcactcgtactcactctcatacacactctcatactcacccatgctcgcacttccagtgaattccacaatgttgtaaataatatattagtcagtctatttgacctacagtactcgaccgcgactgtaagtcgcagaacgtctgttcatgaatccaacaatcagacgagaaatatgtgccgcttgtgacctttttagtgcatcttgtgacttctatagacacccaacttatctcgtttaagccccgtttgaacctacttgtataatgatacaggctgaacgtttgcgtggagagatggaatatcggagaagactgagtcagtttaaaagcgcgggttttgaccgaatctgagaaaaatcccgcttactaacacaagactgaccgtggaatactcgtaatccggtcggttgcgcgacacagcgcttgcaacatcttcttctcctgctcctcggctctttggatcatgatcccacaatttcagagagaagtgtcgatacgcgcattaaagttggcaggtggacccaccacggaggtggaatttgcgagccattgtggacccagagggctgtttggggcggaggaaacggcgccatcaccacctctggcgtcttctgctggcgcccccacgctcattccacaaatccatcaacctcaaggtctgttatgaagatccataattgggttgggacgcgtggcggaatttccacacacatttgaaatgcacttggcgcatccccaagccttcttcaattatctcaatgggccgaatttggcgttcctacagctagccctgccttgtgtgcgatggcacgtttgagagcaagcgatgggtctactgtacacgtacagtacgtcctgtaaggcggtccgatggggagacggcgcgtgcttggtctaaatacgctgctctccatctcgctgtcgtcgtgtttgggccacacatccgcgtctaatattttttttcataaataacaaaaaaccgctggcggtgattttcatttccgtttcgggctcgaccccatcagagttcgggtgctcagcggatatgcatgtgggcaggttgagggatggtggtggaactacaacacgacacgatactcaagtgcgagtaataacggagctattactaagggcgattaatgtgccagtattactaagcgatgtatcgaccagagacgaccgcttactaagtcaacagtgttccaagctcgactgctccagtatcgggctctctgctggccgaccgcactgtagctactgtacttgtaggtcacaccttgtccccacatttaaattcggacacgtgttgcgacaaaaaaaaggactcgctggacctggactcagaacctcgactcgcggtgtcatcgcagaggacgcacgtcgggcacgtccaaagacgcccgtgcgctccacgcatgcacgttgtccggttctagctccgttttgccctctcctaaccccctattccgcggtgctccatgtacagttgaggcactcgtacgggtaaatgtacaattcggaaaaaaaaaaccctagaatcaaaaaaaaaaaaaaaaaaagtcctgttggtcccaaatgtgtcttttttgtgaaccctaacactgaagcctaaatgccaagtcgcagcaccgaacacagacaccctcagcaagcataatagagactcaacccctctcgccgaactttggaacttgaacttgttcactcaaccaccgcaccaaacatgtccaagcaccatctgaagacccagagtgccgttgtgagtatcattgaggaggcagcagttgctggggctagaccgtggcaggtgacacgagcacacgaatggggatggtaacacgaacggggacacgaacggggacagtgacacgatcggggtaacacgaatgcggactgttgaggaaagagggcggacatacagacacagctgctctgaatgctctgaatgctctgaatgctctgaatgctctgaatgttctgaatgctctgaatgctctgagtgcttaatgatcgttgtgcctgctctctagtgacatgatccgccaactgatttgtggacgtgttccaggacccaatgccatgagaacatgaacgtggctggtggtttgaggaaagtggcccatccagaccacttttctggacaaccgccatgtcgtgaccccactctaccttgctcgtcatgatctgtcccctgccaatcgcagggtgcagaagctcattctggtcagctggtcagtgcaattcgctcgttatccagtcccgccagcattggctctgtccgctcgtgtcgatgtactaacaaaggcattcgacaactccgccaccaccgtggctgcttcgcagatgcgaaacgccctcaacaagctctccgactccgtcgaggaccccgcccagaagcgacgattcgagaacgagatggacaacttcttctctctcttccgacgatacctggtcgacaaggccaagggcaacgctctcgactgggaccgaatccagcccccgaaggctgagcaggtcattgactacaaggacattgaccaggatgttggcgccgagttcctcaacaagcttgctgttctcaagcttaacggtggtctcggtacctccatgggctgcgtcggccccaagtccgtcattgaggttcgagatggcaagtccttcctcgacctgtctgtgcgacagatcgagcacctcaaccgacagtacaacgtcgacgtgcccttcattctcatgaactctttcaacaccgacgaggacacccagaccatcatcaagaagtaccagggccacaagatcaacatcaagacctttaaccagtcgcggttcccccgagtctttaaggactccaacctgcccgtgcccaagagcttcgatgaccgaatcgatgcctggtatccccccggacacggagatctgtttgagtctctgcacaactccggcgttctggacgagctcattgccgagggcaaggagatcatcttcgtctccaacgttgataaccttggtgctgttgtggatctcagcattctcaagcacatgtccaccaccggctctgagtacatcatggagctgaccgacaagacccgagctgatgtcaagggaggaaccctgatcgactacgatggccaggtccgacttctcgagattgcccaggtccccaaggagcacaccgaggagttcaagtccatcaagaagttcaagtacttcaacactaacaacctgtggatcaacctcaaggccattaagcgagtcgtcgagaacaacgagctcgacagcgaaatcatccccaacgagaagagcatcaccattggcaagaacgacatccccgttctgcagctcgagaccgccgtcggtgctgccatccgacacttcaagggctgcatgggtgtcaacgttccccgacgacgattcctgcccgtcaagacctgttctgatcttctgctggtcaagtccgatctctacaccctccacgccggccgacttgagatggaccccagccgatttggcggttctcctctcatcaagctcggtggccactacaagaaggtcagcgacttccagaagcgaatcccccacatgcccaagattttggagcttgaccatctgaccatcactggtaacgttatgctcggcaagggcgtcactctcaagggcaccgttatctgtgtctgtgaggagggcaagaagattgacatccccaacggctctgtgctggagaacgttgtcattacaggatctctcagtattctggagcattaaggtataagtagttaatatcaggtagttgttatgattctatggagtataagtacagtacttccgtgataaaaagatggcttctccatttcttaagtgtaccgtaactgttattttcggattcaaagtaatcccaactaatacgagaaacagacagcaacgtgtttgagtgcttcaaccgccatagacggcgtgtctataaataaatctatgaactgttccctcctcaactgttacaccaccagacctgttcctaggagcccccttgctgcgagatagtccaccttttgttttgatgctctcagtttttccttccacttgacagtttcttctctactgagctgttgaggttgccagactggtttgtaaggcggaaaggtgattctgggacatcctgcaaagtcgtattgaatctggtggcagtcttcattcgttttcgttcctgaggtcagcagaggtctataggccagattgtcatctgcgatttcgcgcacgacccacggcccgtcgtggtagtagacaatgacattgagggggattccaggcacgtagtatacgttttcgatccacaagggcgttccatcgttgtcatctcccacatacacctttccgatggactcgacatcaaagtagaggttttcgcagcagatctgggtaggttcgctgacgcctttgagctcatggatcatgtccttgttgttgcagattgagactgggtagtttttggtgatatgttcgaaactgcacgagaggtccattgatgcctgggagtcgttgcaacagaatctgaaagacgtttcgactggtcctggaagaattgttggtggatggccacaggtgatgctgtatcgaaccaccactggcgggaacagacccatcagttctctgtatgccaatctgtatttggccgcgaaaatcaccttttccaccttgttgtccaccgttgtctgtcccgacacaatgaacgacgtctccatggtgtgtttatcgtctataagtcgttcaaactgcgccagagacttttcgttttcagcacctccggcggcaggcttgaatctgtgtgcctggataagagtgtctctgatggtcgttccgaacagatcaggctcatccttgtgtctgtgccatagtttcgaggcgtagtccgtcagatcggcaaggtcctggtggtactcggagcctctcagcacgtttttgcaccttctggcaagttgggccttggccttgcaaatgtagatgcccttgaaactcttcacgttgatgatgaaatggagcagctcggaggcctctgttggatgcagagcccggatatgcgtctggatctcgctgtcgacgctcagccacatcatcttgagcagcatctgagagtaatgggctggttttctgtagtagaggaggttgtcagttgtcagatctccctggatgatgaacggctgggtagatcgcacgtagtcgtaaatgtcgtcgtccgagctccatttgttgaacagatgcacccgatcaataagtccacaccacccgacatggtctataagggccgagacagctccgactccaaacttgagcagccaatatgcgttttccaccttgagcgccgtgtctctgacggctgcgacccagtcggagattttttccagctccgtccacctgagcactatttccgtctgccgcagctttttgatgtccttttcaaagtcgccatctcccatttttgcgtcccgtctcgtagttgcacttccaaacttttggcgataattgaaaccttggaaaatgtcccaaattgaccgctgacgataattgggagtttaaatggagagccttagaagtgcgagtaaaaagaaacaggtaaaaaaaggcgagtaggagtagtagaacattggaggtccaagccacaaaaccatacccatgaggacccatgagtaagatggagatgtataacgaaatgtccaaccaattgaacaaaaatacaacaattgcaaaattggtacaatgacgggaacttgtgtccaacattgatttttttttttttacagccgccgttatcgtggcttactaagccaatttcaccaccaccaacccagtaagtaatacagtttggccggattaatacattgcccatgcaccaacgataacggtgacaagagaaaccgaagggagccgaactccgtcaatcacgtgaccaaaacccatccccaggggctagtcagctttgtcatgtaggctgcgactctctcacctatcgctgctgtcttgacatcgtcccctcacttcactctggcattgcttatctcacggtccaaataaactgtggcgaagagcggctaaaaataaagcatggttgggggggccaaaagggctgctagagatggtgctaaagcgtgccaacaaatgtcaagatcgcctgtcgcctatcaatacgacaaagatagtgcctgtccaaatagcttcgtcccataccccgcttcaccctgtagttcggacgcggcgcaaatagagcagagctactggcatttgtagtcggagtgagagggggaggggaagacggggggtcgcggaggtttgccagggggagggggatgttatggcggacctttgaggtcacgtgaccggtggcgtttggttccgtcggctgtcgcttttttttggggctgtgcacgtgatttttcgcatcttgcaaaaaaataaaaatttatcgtcaatatttcggctcccggatgtcagggtctggggggaggagacgtaatgccgatgattacctgtgcataatctgacatcttattttgtctgcacacgtttgtttgaggcgtgggagaaagggtggtgtctaaaagctgacgccgcatgctgagagcaggctaaggggttagtcagagggagccagagggagccagaatcccggtgagtaagcagttttacatgcatgttgggccgtcggacggctttcgtagtcacaaatgtggtctcgcaacgcctttttcgtctccaacgcacacctgtgggtgtcacttgcccttctggtgtatcgaccctcttccccaccgtcatctcagaagctaaggttgtgttaggtcgattgaagggggcgagcaagagacgaggaggacaggcaatgtcaacaaaaaaacaacaacttcctttttagagagtcaaaattcccgtccagtcccgcacaaacgccgtcttcttcccttcccttcccacagacattgctatatgtctgagatggggcttgcggtggtgacaacaaactgaagcagtcctttagaaggttcgattattttgattgcgtgggagaaggaagaaatggaggggtcggaggcttataaagggtcgtgtttggggcaattggctcgttgtggtcacgcacgcctggcgaaaaacccttgctccgttacacccgccaagtgatcccccgctccgccccgctcgaaggcaacatataaaccgagcgtcgtcccccgtgggtccatcattcgttcgtaccttccttgtagcatgctctcagcagcagcgtagcaaggtgtccatgcatagaggtgcaaaaagcttaaatgcgcaagtaaatggtccatgcctgcactgcaccctcccagttttatatcccgttggtctgccgtccgaaatctctcagccccgtgtacaagtgctgaattgccccgagtcgacaaactagacgctgttgccaccacgcccgcaagcacacaccccgccacacacaggtttatacaacagacacaagccgaacgccacaaccatgcaccaccacctcaaccccaaggcgctcttttctggtgagtatggcggacagaaatggacggaggaacgtggcagagccgattgaccagccacgcaggccgaccaagccccattgagtgagccattggacgtccttggcccgaatagacgctctctcccaggtttgccggaaaaacgagctgttatatccgaacgagctgtttgtgcccaaaaaagcccctactaacccccaggccgaaaggagagcacctctccccagacacaagccgcgtccggctccggagccgtgtctccaggccgacctctggattcgtccaccaacgtcgaagatgtggatgagcttgacggagacggccagaacatcatcatgggaattatcgcgcagctgcgacccggcgctgatctgtctcgaatcacacttcccaccttcattctcgagcgaaagtccatgctcgagcgaatcacaaactccctgcagcaccccacatatgtcattgaggcccacgccaccaaggaccccatgcagcggttcatccaagtggtaaagtggtaccactccggctggcacatcacccccaaggccgtcaaaaagcccctgaaccccattctcggcgagttcttcacatgctactgggactacgacgacggttcccacggatactacatctccgagcagacctcccaccaccctcccaagtcatcctacttttacatgatccctgagcacaacatccgagtcgacggtacactggctcccaagtcccgtttcctgggtaactcagctgcttctctcatggagggcgccaccattctcaagttcctggacattgtagatgccaagggcgctcccgaggagtacgaaatcacttcgcccaatgcctacgcccgaggtattctctttggacggctcaagtacgagtactgcgaccactcgatcatcaagtgtcccgctctggacctgactctggacctggacttcaaggccaagggcttcatttccggtacatacaatgccttcgagggccagatcaagaagatctccaccggcgaggccttttacgatgtttatggaaagtgggatgaaatcatcgagctcaagaacctcaagaccggcgagaagtcggtgctgtttgacgtgactaaggccgccctgcaccctcccaaggtgcgacccatcgctgagcaggccgccaccgagtcccgacgactgtgggagcccgtcaccgacgctcttgctaagcgagaccacaccgttgctaccgacgaaaagttcaagattgaggacaaacagcgaacgctggccaaggagcgagaagagcacggcgtcaagttcctgcccaaactgttcaagcccgcccccgctcccctggacttcattctgtataaggatctgcacggcactcccgaagagatcaccaaggagattctcagcatagtccccattctgcccggccaacagttcaccaaggactttgaaatgtccggcgagaagaaatacaagctggagaagagcggccaggccagcagcgagactcagcccaccgccacgaccactgcggctgccccccaagcaggcgctgtccccacaacccctgctaacggccagactcccctggccaagacttctgatcttcaggaggctcttcccaccgaagaggacgagttccacgacgcccagtagtgtccatgacccagtagtgttccacgacccagtggtgttttccacatgtttttgtatggaggttgcaagtgactatatatagtttgatagagattcttaaccaaaacgagcgacgtcgcggttcgattgtaaagccattgtaaatgtactggtatttaatgatattttatctatcgcgcgcttcggcccgagacttactcttctgtttacggtcactatttcaaagttgaaagttcgagtgtgtcgaaataaatgcccagagcctcttttgcagacagctgcccaaaagtctccttctcttcatcacttggtcagtccaaactgcgattgctttgcagctatatctccggtcagaaatatgtggagtccaactgccggcagtggcggcgctagcagcatccccaccagcaacagagctgcatacctgcgttctctgtcgcactcacaggagtcggggacgtggaaattttcgtcttcgtttgcgcggtcgtcggcgacgtctctggacgacttttccgatcatctagaccttgacagcgagatggaggagagcacttccacggccgtgatttgtcacgacgaggatgacagtgatgtgttggaataatttgtatgagctgctggctccaatttatgtatttataattatttatagcagtttacagcagtgcttatgaagtgaagattacgtatatggccaatttcctcattcaatttgtgagtttttttctcgacgattattttaggtggtgcgcaatatgatgcatttaataaaataaaacaaaataaaaacaaaattaaatgaaataaaattaaatgaaataaaaatccaagtccgtgaaaacacatcagattagcttataaacagtaccaatcagtagccagcccttggttgatggagtatggccatctaattttcagctcttcactgtcactcctcgtgatgtagttcggtgttagtcccatactcatactccgccctgagcaacgttcctatgcccaacaagttctcaaaagcgactcggaagcgagctggctggctcaactatggtctccgggacaaagcaatgtagtgttgtgtatcgcgagtagcagtcaggaggcccctgacaaacccctcgttctttagaccgaatcaccttggcgacatatcttcacagccgcttcctgtgttcaaagtgcagtgccctcctgcttggtgatttcggccttcctccgttggtgagagtcgggttgtcattcatcctatatatatatatatacatattctcaattaattaatttttacaaatttttatattttttctgacatatttccaatactacccataattccaataattccagctcattaaaaccctcctgtcactcgatccacacgctaacacagtccagtcgtacgataatgggcgttggagatggagttgggcgacggaaactggtatacgacgagccagactagtggggtaatcagcagagagcagagagcagagagcagtgaagttagcagtgaatcagctgctccagtgtgttcaacctgctctcctgcccgccagatcgactcatcattggtcgagtatcgccgccaagtctccgacaaggagcccaggacgttgacaggagcccaggacatcctcctttctcagcaccatttcggcgtgctatcataaaaggaattagtgcgttttgtgcgatggcatttggagctaaccgaggatggggcgagggtgctgagtaagattgaaagagatcgagagagaccgaaggaagccaacccagcagaaacgccactccaatctggcctcggctactatctgggtgtggtacttccggggtggcagtctagtcaagccccggtagtctagtcaagcctacaagtagtggtggagtcatacgcgaagtgaagccacagttacagaccaaagatggcagtttgaaattccgaaattagccagagtgtcacatctagtgctgagctgactacgactactactacgtagagtgatagtcacctcggtccccatcacccaacaccacccgccgctgaaacgtcttcgcctgcgtgaatgccgaccgtgttagcctgctacagtattggtaccttacttgtagcatttgcgggttcacgcatccacagtatctctttagcatgtcacacaacggccccggccacgaacatggaccttttcgtccgccgggccctcccgctccgctctccatggcccccaccgtgtccccgccctcccggttccactccctctcgccttccacctccaactccaacccctcgccttacccgcgttccatgggggagttccactccaggcagggtcttgaggcggtggagacgtcgtttgccagtcctcccgcctcagagtatctccagggtcccaccagtgagccgtggtccgagacctttgtccaaacagaagatccatgcaagcttcagcaatcagacaagatacagcaattagaccaccccagcaatcagtgtcattgccgaactatggagcggtaggttttgccagtaatgtcgaccgtgctcttgtcgaccatgcacttgtcgaccgtgctcttcctatcgaccatgttcatctcggtgctcatcacgctgctcacgctccaagcaccgtcgaacaaccgcggcttcagctgctcagctccggagtgtcaatcaccgagagcggtgagggagtcattccccaggaggctctgtctattggtgatccggggttcgaaccgttccgaggagtggtagtcaagcagaacaggccgggcaacgagaaccaccgttctggatcgactgcccgagatccctggggacccaagtcatcagaccatgggcttgagagccctggcggagaaattggaaactgcgtaaccggataccctctggcgggtttccgacgacaactgcaagggtcagaattgctgaaacaggtttcccaggcggttcgagaggttccacgaagctcacagaagaccgtctccaaaccgacgaaaagtctgcccaaatcagcaaatctgcccaaagccgccgagataatcccacgaattggagtgtttgaaggccaccagtttccccgggctcagggcgtttcgcgccttcttcttccttaagagtgtcagcaggcggttattgaccagggagttagtgaagttcttattcacggggttccgaacggagttcctattcacggggttttgagcagagctcctactcctctcacccacccactacatcattcttcaccacaacatctccctccacaacatctccctccacaacatctccctccacaacatctccctccacgcatctcccttcacaacgcaccttcctccaccttcccatcactcctacggtcctctcctcaacctcccatagagttccgaccacaccaattttcccgacacaaaccacccgcgcggaccatcacccctgacccttccaccatagtgcctccagaaacgcaatatggatgtgtggtggaaggtccgttttccgacggcggctggtttggtctgaagcagaaaatgactaaccctccggtgccgtttgaaacgccggtgctcaagggggaagattccgtcgtcccgtagggtgagtagttattcagatgtcttggttgtggtcgtaactgttactgtgactctgggcagacctcaacctgtcgatgaccactccgttgctcacgagcctttccagaaccactcaagatactagataaccaccaaacgctccgccgtagctcaacaacggggactgcaggtatagtcgacaagcgaatccggttctgggacactatccccggtgcgttactcaacgaaatcgacacgggttcgagctcgcaggtgttcaatcccataagaactccaacgaagtggtgtcgactcatggatacaaccagaaccagattatcatttggaaccctcaatgaagcaggtggcacagctcaagggccagaagtaccgggccttatacagtacagtacagtacctgagtatgaatgccgatggtcgtcactggagctggcgatggactctgcggttctggaatataaccctaccgacgaccaaggtagcagcggcgttctggacattttcatttgtgatagaagaggaggcatcatgcccggcctttctatttatattgtactacgtatatttggataagtgtgttaagccgtagtggccgcatctccatctgtttttttttttttttttttttttcccattagtcattaaggttctgcttgtgtgaatttgtgtcttcaaaaaggggactatttggtgtcagattggccagataatcccgttgaccgtttatatagctttgattgagctctatgacaattttcagctcaatattactgccggaaagcctcgtcgaagtgcactggttcacgcgcatgtttctacagcatgcatgttaattaagtggaggtttgttttacgcgtttcagtctccttcaacatggccaaatcgaattcaaagccatactacgccgtcagaaagggccgaaaaacaggtgtatttacatcatgggaccaggtgcagccgctggtcgacagattccccggcgcccagcagaagagattcgaatcactggcccaagcggagctatgggtttccacagccgtttgcgtgtctcctccaaagagcacgccgccgtccagtgctggttctaacggaacacaaagtcctcgcctcgaccgcagtcctcgcaaaccgacgtggtcttcgtcgcaatcgttgggattggagggggtccgaagagaccttccatcttctcccacaagatccaagccgaggatggacaactacacgaccaaggtgaacaatgagaagatggaagttgcaacaagggcgacgaatctggaaaatccgacaaacttgacgggaaaggaggagacaacatggtgtcctacgaccagtgagatggaaatgggctggtccatgttccgtatgatccagtctgatccgtggaacaaggtggaggtggagggacgaatagaatctggacggacattgtttgagatttatttcaacgaaaacaactcccagaatgtcgtgcgtcctgttgttgttgctgactgccaaactgaggaggaacaggtggccagagcagtgttggtaggtgtctatgaagcatgcaaattgatacacgctcgcaacgatggactcaagtacgaaatacagaccacatccatgtttgtcattgagtgctactatcgacggtgtttcaagtggcagattaatggttgggtggatacagacaatacccctgtacctcacagagaggtggttgagcctacgatggagttgttgcagcagttgaaaggaaggatcagatttgggaagttgaaggtggtggaacaatgaactcggaatgagccgaagatagatctggaggttgatccagttccagcagaattcctcagactgcagcgatttgctgccagaagtattctagaatgatacagatggttcttcaagctccctggctatgcggagtctgttcttgctcccaagcagggaatgcgacatatcgttgtgatgaaggcaagatccggaccggcgattactttcaatactaccggtattgataccagtagcactgataccctcgtcgtactacaagagacttattgcatccatactctcaagtctacagtagatctgcagctgtacaatttattcagctatcaataaatacatgttcctgtaggtgagctaacatttgcaggttttgcaaccgcacttggtgcaagcacaggaggcgggcatactgctctctgaagttgaagacgagcagcagcagttgttgaccaagttgtgcttggattgggtggaggtagtgaagatgagagaagttccaaacatagcagtagtgaattccattatgtgtgtgtgtgtgtgtgtgtgtgtgtgagtgtgtgacaaccgaattgcggatctcgtctcctatttatatctgctgctgctgttgcgaagagcacatattgcaatctggtaatttttcacttttttactaattatttcagccgcagcgataatctcgcatctcgcatacaagcgaaaccttagcagcataaacccctcgaatgctccagtaatgcgcggtaaaataccactgaaacggggctaaattcggccaaacggcattaataatgaaatatctcacaataatagcccctcctagtgtttcggagtccgaatgtctagcatcatgtggacttgtgcgttttcggagtcctattggaatatacacttcggaactttgacgagagatctacaatatgtacgatgcacctgacacagacgttggaagaatggagaaggatagagacttgagtggcacgcttataatgacattagttcgagttgaatgttaaaagtaggtgaatcgaatccacatagtccaggttgagttgcttctcgtacacccttgtacaattactatccttcacacctttacacatttccattctctttcagacccttctagcaagttctacaaagacattgtttactttagcgccacctaaatcttagtcaatcattggagatatgagaagtttgtgccacggctgtgccttttttctttgtctaaccgcattctttgcgacattagtgctactgccgatgcagatgcgtactttgcgctgcggctgaatacaactgtattttgaagatctaggaacgggaaaatctataaatacggccagatgtccctccttttctcactgcacagacatcttttcattcaccactctcaacactacttccaaactcactatctcaatggaattcactagcgccctgttcggagcttcgctcgtccagtccaagcacaagaccaccaagaagcacaacctggtcgattcctgctgttgctccaagcccacagagaagcccacaaactcctgcacttgctccaagtgtgcttgcgattcttgcaagtgttaatttattgtgttattagaaggattctcgttaatacatttggttaattgaattatttaagctttgtaaaatttcaagtaaaatatataccacggtagaaagacagactatgattttcacagcaatagccactaagtagatctaaaggagacagaaaagacatccagtagctggttagacggtggcaagtagaagaatacctcggatcacgtgcttcacctaaagaacctgtggtttaatttctccttgtccccaaaagaatgttccaagaacaggaaagttcgtcatgcagcttatcgttggcgataatgcacctgcgatgattacctgcaggaacaatttgtagagggttagcgatattgcggtctcgctggtcaatttgaggtcacatgacagagtgtttttggtgttaaaatatggaaacacatcactacaactgtcatcaatgctctaattcagcgttatcagcattcagaaagcccgcacttatgagcgttagaaaaacaatattggggatctatgagtgaagtagatactatttgtttgacttgagcttctcttgtatcactaatggaaattaatactatacgaaaagggctgtttcatgtgatccttgcacattttcaagaccgtctcagttttactggagcctgaggccgcgaaagcttgggagatatcttaaaccgatttctgctcttcttttcaagatatgtagtcactcaacaggtgataactacccaaaacttctttgatagctcttctcggatgcacttgattggtataaccgtccagtcagacgacggagttgcaatgttgggaatccgccaaggtgccaccgatcaatgatgttatcggggaggaccagaagctacagagctttccaattcaaatgtgcaacacatgagttcctacgagaacactcagaaacgagttatagtcttccaggagagcgtcgggaagaagagcaacaaagtgaacgacaagtcacagctatatttacaaactgaagtcgaaggctcgagatattgcagtgccaagaagtcaaatattcgatatatctcagtctcaagagttgccctctgaggaactgagtcagctgcccagttactgtactgtacacaacgttcctactgtgctgttgaatgactgggtgagattggaccaacaataggcacgtaatgaacccctcaggggctctcgctggttaccagtcactcactaacgtgttgcaccgagcaaacattcacacgacaattgacacagcagtcaggagattcaatagtcatctgattgaacgctgcatcctgattgcgactgagtcacgactataaacaacaacagtgtgtgattcaaggcagactcttcatcaatcgagacggcgcaatacgtcaaacataaagaacagctgttagcagtccaacctggtgctttgtccatgagcgatacagcggacccatattcggcccaacaaagaaggacatggcaccaatgattgtgcggcagaggcttcaccaggcttaactcaagagagagacagacgtagctactgtattaccgtaccagttgtactcgttcccgtactggcaacagcaacgagttaccttgaatgaattgtcgtgtggcaccacgggtttgatgctttataaaatgcattaataaataaccaagcctacatcacacttcaactctaggctccctcctgtagaaaaagttgagagcctgcttcttcagataagcatccctttcttttgtggctttcatcagagattgaagggtgtttgcagctcctagcgtctttccctcttcctccttctcaggaccctcatcgagttgcgttagccattcttgcgccgcttcctgcgatacagaggtcagcaaggttctcagacacacatagaaggtctctgaaccaacaaagtcattctggaccacccggagggtgtccaataccgcccttctgtccttttcgtcgagtttcagactcaaatacgtgaagaacgaccatccggaagtatccgagggatgcttcgaaacccacagcagcatcagagacagcagtttcttgaaaagctccttattttccttcacgaccaaatcagtcacccatctggcgtatccccatgcataatagttgtgtttgtgtacctgagctgatcttagaatgacgtcaaactcgtgttccagaaacggacccaggccagtggtatcgtagtagtgcttcccaagcagcgcgttgattttttcgaggtaattgacttctttgaagagttcttttggggtaaacaggtccatcgaggccgacttgacaaacccacgtcggtagttccacagtgtcgggctcttgctctgtttcttgagtttagacgtgagcagcagatccagaaaccgcagttcggccccctcactctgaaggccctgctccaccagcttgtggcgaatattggtagccgaatggtgttcataagcagccaaaagaagcacattggagagatctagcactgcttccgacgctggcgatgcatcaatggcgcttctaaatgtcttctgagccaccaaagccgccgttaccatctcttttttgggcacacaggcggtcgtgatgttcttgtcctccaccagttgaaacggcttgaatgtgtcgtccgtcggcacttcttctggcagctccgaaggcccgatttccacttgatcgctgggttagtcgtgtcgggcagtgtggcaaaaagtactcacgcggccaataatgctctgcttagtttttgaacgagttccatggtgatatggaggtgaggaatatagtgactgcatggctcatcattgtagtagagctggaataaaccttggtgttcaatttatgagccgcacagtgacattgacgaattaagaaaaattaaaaaaaaaattaaaaaaccaaaaaatcttctgttggtacaatactatattaataacatgtatggaataatgtatcatcgaaagagccttcatatacagtctcatgtcacccagtatgttccgtgaatcgagaaaaaaatgcaatattaaaaaaattatgtaaatagaaatggctgcctccttctcctttgtcaatgccttctctctctctaacaccaggtaaagaaaggagcctttctagtggcaatctgaagtcgctcaacaatcacctttctggtggcttggtaagaagactcggcatgcgaaaatcccacgtcattgataggcgagtctgtgttgttgttatcagctactctcagcggacggctggtggcattctcactgatgagctcgtcccacagactctgacgtcttccgtggcgcttggaaaatgcaacggcgttcttcttggtgggactagaacactcgagctctctatacctggcctccagactgagcgaggagcccttggaaggccgcagtttctgattaggaaccgtagctggcgcagtagagggtcctgctgaagacgaagcgttgtcgtaggaggataggagtggaacctggtcgctattgaggctctgatttttgtttggcgacacagacaacgagttgagagcaggcaacaacatgttctcgtcaacactggattgccgggaatgcatgttcgatggagtggaagctctgttcagcagaggggttccaatagctgagttgagtgtttcgataggaattcgaacgggaatgtccatctctccgtcccaaatcagcaccttgtctctccgggcaagctctagagggccctggtcatgagacttgagcgtttcaacgacgttgaaggcctgacctttcatcacagcccactgttttttccacatgcgctcccggaagtcggggtcgacactgaacaggtctcggaactccacataggtctgttcccaccatctgggagatgtcaagagcggcaagaagtgctctcttgtttctctggagaatggctgaccgataagttctagcggaagaaagagccagccaaacggatacgatctccattcatcagggtgcttccagggccacgaaagacccgaatcaatggctcctatcttgagtcgaggcaccttgataggagaatgagaagagtggggtgtggcacctcgtgaaggagagccctgcgagtgatattgcggatgggctgacgaagcatccacccactccagcttgatcatccaattgtcgagacctcgatctgtgtttcgcataatgtagtcgagaatcacgagcttctcgagctccaaacgaaactgtttttgaacggcaggggtccaaatgtccgactccgatgcagctccgtactgctgacgtcgcttgtcgggccagggatgctttctaaaaaacacatcggcctcctcgtagttgtgcagaaacagttggaatgagccaggctttcgtggcagtagacgagcgtcatttttggcccgtcgacgttcaaaatatcgatagtagaatgttggggaggagagatagacaatctctgtatgagggacgattcccgtctgcagtctgcggtccaatagcgatgccgcggcctcacaaatgtatccggtgtttggaatgagacaggagcgtccaaagaagcatgggaacaagtttcggtgtagccatttggtccatttcggagacagaggtccatatggctcttcgtcctttggtttaaatacgcccacaacttcatggtgttcattgtaggcaaagtagctgccactggagccctgtgcgatgagtctgggaaagattccgtgcgaaatggcctcgatcaccgactcaatgacttctccgaaatgcaccgctgagttgtaatcttcttcggaggtatcgagaatttgtcgggactcgaattctggcaggtttttgaagacggagtagtagatttcgactgcccgttcctgtgcggggttgcggtctggtcgtcgcacaggaaatgctgtagatagttttcgtccgattcgagagaaaacacccatccatgtggacgatcccgaggcgagcgagtctcgatccgagttgttttgctggttggactcgagatccacaaaatgcgtcaattgatcaggcgtcttgaactcattaggaaccagctgggtaccgggagtaccccaatgatgggctggtgtagaagtcttgggagacagatcggaggcattaggcatttgcggagagggcatcaggtccttggtgaccaccgacaagcgtcctgactggatccccagagctcggtgtgtttcgttgttgcttattccctcctcagtgtattctgccgactgagcggtttcccgatcgagactagctagtcggtcgtagccagatttgaacactctgtctccgtcggtgacgtcgccgttggaagccgccccgttggagcctccactcgtcggcctcgtcgctttcttcgttggtgacatgttgcagatgtatcacaaccggcagtaacaaggcgagtgatattgtagtctccggaaattcgtgagggtgggggacgcttgtgtatgcagtgccgtgaatctgtcgaatatcagtcctcgagccgtctcggtgaaggtgtatctaagtgcttggtaccaccttctcctgctccggttgacaactatatgcaccaccctgcggcctgggtgtatccaaaagttaacttttggcgtgtttggacatgtgatctggggactcaagggcaaataaacagctatatatgtgcacgtgtgtggctgacagccgtgtcgaggacatgtgtcccgctcaggagatccattatataagcggtttcatataaatggctgctccaatcacgctatcgcactagcgaggccctccctcatttctccttacaccgcatgacgtcggttgctgaacgccacaagactgcctgtattcgccacctggggtctccagctgcgagaaaagaccgccagcgacggccaaaagggtcgattaatttgattttggtgccttcagcgtcccttgtggcgcctgcaagggacccgtgaattgtaactcgctcggaactcaggggtgccaagccgctagcctagaggttagccgtgccctaaaagtgcattgattgagtgggtatgtcaggttaggcttggaaagtccctagaataataaataaaaaagatgtctgtttcaggcaatatttatttggcaagtggtagtataagttgactgattgatgcagacgtccctgttatttgattcagacatttgggtatttgatttgtgatgtctcctactctaccatataaattgaaaatggtcgaaggctctactcataacaacaacataatatcctcaagtaattctctgttaaactccgacacgttcctccactttacttgggtagtagttaacattattggcgatcacatacagtacatacgatcctgtgctaacatactcgtaacacgactgcaagctgctctgaaatcagaacgagtcactggagccaaggggaagtcgttctagccgtaggtggcaggtggaaggtcgcatatcacagattaagatggcgaggtgagaacaatctgatcctgtgcttggcttcgtacctactggagtgcaactgtcaccgacggactcatcgacacgcgcaattgtacaagcaccggtgccgtacgagcgataaggtgtcactcaaatggtcgaaacagacgaatttgtggagcttaccccgccagagatgacttccttgagaaggtactctcggatctgtgaacaaggcgaactgatgctgacttttctatggctctatgacactatgatgtcattaactcgactataattacatgaatggtcaaaacacggccaccttcgttgtgtatactggcttacttcttacaaatcatgactaaatgttgagattagagcccatattcaaaggggagaagatagggggtgtctagtgaattcctctgcggtactgtacggatgtaacaatttgaacaacggcgtttcaagaccccaaactactttgtagcttcaactacttctacttgtagtctgttgatgtcttacaaagtgagacacagcctgaacagtagtgtatcaacttcggtaatatatcttggcgtaggagggatagaaacctgaaaagtggatattcgtaacaggtgattagagagctttcatatgatacagattagattctcacagtgtaacaaatgatggagatctctagagcgtagttttggaacgcatcttgtataacattcgtgaaatacgcgatattaatttaacagacgcgaaaagttgatagtaagcacccacatacaaaaacttgcagtaggcttgacagaaaagaaataatccagattgtaatcatcacgtgatcataatgtatctataatacactccttcccccaaaaaaatcagcaagaactgtgtctcaaactaccctccttttcttgttgacgcgtcgtccaaaaaaaaacagaaaggttcttcagagaatgtatatatatcaagtgtcttttcctatgtcgactcgaccaaaagttacggtacacctgctagacaatggcctcaaaacgacaaaagggagccaagaaggcgcccaaggacccaatgcccatatatggagataccccgacccactaaaagtgactgcaaagatgactattgctggtttggcttgccctcaccccccagggacgccacggcagatagaatggaggatcaggtcgaccactgcgtgtcacgtgaatgatgtgggcacgttttgctataccgattccgtcaaaaggcctacttcctgtccttgtgttactctgactttgacaagaagatgttcgaggatcagagcgaggcttttttggactgcgggtcggaagtcgagcggttctttgcgctggaccaaaacaagctcctggtggagttctctggcgaccaccgtcttctaatcatctccaccaaggacgactgggagactcttgaacagcacagagagcccatctctaagctgaagggctatctcaaggtcaggtacccccatgacaaaacgctgttttcgactttcagaaacgctggcaacaaggatgtgactattgtctgcgaggatggtgtggaggtgcctgttcactcgatcgtggtgactcctcagtggccccattttgccaggaccgtaaatcagtccatcgataacacctatcactttacaaagctgcttcggccttccaagtgggtcatggccatggtttccttcttctacaacgagagaatccccatggatctcgatactgcctgtagagttcttattttggccctatcctacgatatcccgcatctgggccctgctcgacgtgctagcaggcgtttgtggagttcactatgaaaacctcgtttgaagagagcaaccatttcgtcgctcacctgtgtcccactaatgctcctcggcctaggggaatgaatgtagttggatgaggatttgtagcgagtgttttacctagtcatgaatatttattttgcagattccaagaagagatggtgctacttgtagtacatactgtacagtagcggtgaaggtagaaaaggtggaaagtggatgtagtgctggaggagactcgacagataatgttgtgaatggctttctcgagctgctttacttctcagcctggaacagtctctcgatctcaaggaactcatctccttgagctccgggagtcggaagtaggcccaaacaatggccaggatactgcatgggccatagataaacccgataggagcccgtatcagcatctttctcatatatgagtaccgtatctttttgcaattcacattccaaacaatgtgcaagtcaagagggagagctcccatgtacagagttcttcgtttgagggttctaccgagcgagaggtggatcgatgacgataataaacccactgggccacttctttggtcaagcctcctttccctatcggaactctgcccgacatctgaaaagtgcaccacaaactattcaagcgattctccaagcgagagatcgatctcctcactgtcccccagcccgttctccccaggggcaccctgggcttttcgctcgaccccagaacaagaagcctcatgtataaatagtgtatataatagcaagctactgttcccagttgaagagcgtacgtggaccacgagtgcgctctaaacctgttggccagaagtagtgaagtagcctgttgtcgcggaccacgagaccaccacgagacatcttagccgtaagcctttttatgagctctggactacaaatcccacagtcctgtagtcaagtgtagtcaagtagagtatcagcatcaactgtacagtaagatacttgcatcataaagcatacagtaacaagttaccttgtactactggtagtggttgtacaggggtactgtagatacaccagtcgaaagtgtgcttcataggtgcctcttcttcagccctttgcccattcgagaacaaagtacatactgtacatactttactgtacattacttgtacaagtgtacactacataggtacatgcttgtaccgaactgcaacgatctgtctgatagtggagcaatggaacgtcaaaagagctgagatatcgtttcatctccaatcgatcttactgtattccaaatccagcccaatctcccctactttttccccctagagccaccagataagtggctgctagaccagcggttctcagcatcatgctgaggaatgcatgtgagtttcagaaagtaggacaacaagtagagtctagagctggaacaagtagtcgagatagaaggcttctgtttgtctattgcgagtattcgtattgtacttgcgctgtaacgcgcttctataacgactcaattgaactcctacggtatgtactcgactcctaccactcaactcctaccactcaactcctaccactcaactcctaccactcaactcctaccactcaacttcaaagcccgaatcttacaccaaaccatcaccgacctcgcttgcaacctccaacacgtcatcgctcaccaacgttgtctggcaaagactttctgagaccttccgtgcttgcagcgtttgggttggactgcagatggtgcaggggaagcaaccatctcgggggatgggatttcacaggagatggaccgcgtataacccaagtgagcacgtcacgtgactgtatcgtgctgtcacgtgagcatacacgtgacacgagaatgagatccatcctccagacccgggccaatcagaaagtcgctaagacccactccagacggtcactattatccgattggcaagaggcgtcgcaccaacttaaaagacgattcgattagtctcagggtgtgagtcgtcggagcccactttttcagttcaacacgcccaccgggatcggaaatggctggtttttgggtgtttatagaaccatctcccgcctcgttaccgtccgacaattcgtgtcacgtgtttttccgtgctggttctctacttgtaagctgtcttttgtcgacgactagtctgcatcttgacgtgtccacgcatggtaagttgaacattattgtaagttgtaggctgtgttgtgccggcaaccggagttggagtggagacgtttgagaggggtaattcgggggataggggaaagggaaggggtgggtaatgggggggaaggagaatagattgctcacgtgacgtggattctgcagagtataatcgactaccagcttctcttgtcgtcgttggttggagccaactcatccattctctccattagctgctggtatttcttttccaaacaatggccattgttttcaaaccttggcgccaaactctagtccccacgcgctaatgacaacgacattatcatgtcggccgcgcaggatatataagcgtgcttcctgctgcccttcttccagactctcagacacactccgactccacaatgaaccgaaacgactacgacgacaaccgaggcaacagccgaaacgactcctacggcaaccagggccgaaacgagggccgaaacgagtcctacggaaacaacaactccaactacggcaacaactccaactccaactctggttttggtggtaacaactccaactctggattcggcggtaactccaactccaactccaactacggaaacaactccaactccaactacggaaacaactccaactccaactccaacagctcctacggatccaactccaactccaaccatggtggcaacgattcctacggtaacaactccaactccaactccaactacggaaacaactccaactccaactccaactccaactccaactacggaaacaactccaactccaactccaactacggaaacaactccaacaactccaactccaactccaactccaactccaactccaatgtcaacccctacgttgccaagggtatcaacatggtggaggaaaagttctttggaatggaccagaagaacgagactgccaacgagcgaaagtacgaccagaagattggcgagttcatcacctccaagattggcggcggcaacaagggctcctccaactctgcaaacaactccaacaactcttacggaaacaacaacaactccaacaactccaacaactcgtcttccggcggaattggcgtgagtattacaacgatagattgatctgttgcagcactacacaggactgctccaatcatggttaattgaccacaactaacatcagggcttcatttctagccagctgtctggaaactccaactccaacaacaactccaacaactacaacaacaacaacaacaacaacaacaacagtggaggtgacagccttcaggacaagcttggcgtgagtatttaatttccccagtatcgagagtgcgaatattaatggttttagggcttcatctctggcgccatgtccggcaacaacaagaatggcaacaacaataacaataacaataacaataacaataacaacaatggaagcgaaggtggcctgcaggacaaggtcactggattcattgctggagctattgccaagcagggccagaagcaaatggagaaccagcttaaggatcagatcggagtatgtatattttctttttttcaccttccccccatatcaacctactaacacaacagtctttcctcggcggtggcaaataagttgcttgtctccttcccccaggcgtatatttatagcgtaatattagtccgatcgaattgaccgtcatcaccatggcgtgcacttttatgttagtgttttagtttcatgacgatcgcgccaaggtgaggctatcagagttcatagcggcgatttatgaccgtctaagttgagatgaaattggtggcacgtgaggagaagctggtgtcacgtgacatattccgtatggtgactctcgcttctatccactgtcgggtatctggaagttcgcctcgttcctgcggttatgatcatcttttttttctttttcgtctagcttaaaattggtacttgtagttctctataatgatatctgtatagtataccattattggtatgagtacggtatgtcaaaagttacaagtacagtagttgtacaacttttttttgttggccaacggcggttttgtccccgtgtctccatctagtaaagctgcttgtaaatggcgtcggacattttgatggtctgcttgatgtccttgacgtcatggactcgaacaatgtcggcgccctgctgaatagctgcagtgacggtggcagccgtgccgagaagtcggtcagccgcaacctcctggtcggtaattgttccgataaacttctttcggctggttccaatgagccaggcgtagttgttgaggttgcccttggtccgaatgacttcctggttcttgagcgtccacagattctgtttcaggttcttggcgaaaccgacacctgggtcaaggatgatctggtggcttcgcagacccgagtcacgagccttcttgacaatttcctgcatttcacgcgccaaaacagccacaaactcctcctcctcggtgatgttcacgtgggttgatttttcgttggcagcgagcgtgtatgtgttgttcttaacgtcttctctgctgtggttcaggatgatggggacaccgagcttggccacggtgggaagcatttgagcatcgtaacaaccagcggtcacgtcgttgatgatatcggcgccggccttgatggcttcttcagctacttggctgtagaaggagtcgatagagagaatcacattcttgagctcctcgcacgatctgatcttttcgacaacaggaataacccgcttcagctcctcctccacgctgacagtgtcggctccagggcgtgtgctctggccaccaatgtcaatgatatcggctccctcagccaccattcgcttagcttcttcaactgcgttttccacagtgaactttccaccatcagaaaacgagtcaggcgtgatgttcatgatccccatgagctgggtgggtctgttctttcgttgctcaatgtcaaactccaggaaccggccagtttccgactcaagagagccaacaggaacaacctcgttgagatcagacgacttttgcacgttggagctcttgggaagaagacccagatgctccttgaacgacttcatggtcacgggatgaagtcgatcgctaggaagaacgtccaacagaggtttgagcacgaagcttcggtcaataacaccggcatggggaatggtgagtctggggtgcttgaagactcgatcatcgtagagaataatgtcgagatcaatggaacgaggacccttctcgacctccttgactcgcttgagcttctcggactcaatgttctgagtcacatcaagcagggcaatgggttcaagagacgtgaacactcgcagaacaccgttgatgaacctctgctggtcctggacaaacatgggctcggaaatgtagtaatgggacacatccttgacttcgattcctgccttctcgagttccttaatggcctcagagatgttgtaaaaggggtttcccacgttggatccgaatgcaatatacacttcgtgcttcaaagaagcgtccttgggcttgtcttcgttggaaagcacgtattcggacttgagctggtccttggaacgggtgatttcaactcccgcagcctttgcaaaggtaagagcactgggtttcttcgcagtaacagtagctttttcaactccaagcttgctgcaaagaacgtcagccacagacgtgaccagagcctcgacagttttgtactcagaggcctccacgtggtccaccaccacatccaccacatttctgaagttgtaggctttgtcaaatcccacaggcgagttctggggcttgtagaggatgagatcaatggtaatattttgtctgtggatacgctcaccggcgttgataccgataatagtgacgatattcagcccactgatgctcacgacgtcggtatggtttgcaggtgtagaaatctttccagtgtaggggtcgagctcgcggatgatctggatggtagcagactgtgcccgaagcagagcacgaggtttgctgaccttgatcatggcccatgcggctccgcagccactggtgaggattcgtgtactgattgcatcggcgatatgttccagggagttgaatttgttggtttcgacgagtttggtgacttcttcacacacggttgcatagttgatggagtcgggcagatggtcgagggctccggacttggcgatactcgtcttcatccacatcgacacctccaccggctgggcctcgtttcgttgccatgcatctactccaatgaacgttttgagcagcaagtctttgaggaagaccacatctttggatcgggtcgagtccgacgcggtgttggacagaggccggtctggaatcgcttcactgaccatttcggaggaggtgaaaaaaggtcttgatagggacggtgatgatctgagcgaaaagcggggcgcacaaagagaacgagatggacgagatatgctcagagaagccggagagcgcgaaaggtgtctgatccgcgcaaaaatcttgaaatgtctgttttcaaccgccttttgaaaagtatcaaaagtcgagttggcaggggatctataaatccagttagcgttaggctcaaagagtcagtcaagtggactgcagaatttgagttggataatgtggtgatatttgcgggtttggacgtcaaaatcccgtgatgaagacggaataaatctgaaaacttgacattaattcttgataattctgcaagtccctttttatccagagctattagtaatccttcccccacatcagccccccagagccgtcccattcaacagcatgttagctgcatccctaatatgacgttgatctagttgacgactacgcaacaccaccattgttgggccgataaggtagctggaagaaggagtagatggagctttttttcacttgattatatcacgtgcttgttttttatccactgttcttgtctatttattgtggcattattcactttttttattcagaaaagtgcaatcaactctaactgtccccgagtcgaatacataactgcacgtggaatgagaattattgagaatattattttccattttttaaacaggataaattagagaagatctcagaaattgggtagagaaaaaaggaaatcacgactgtctagtttaagtgtctaaagactattgaattctactccgaaagaggatcacatccaatatacaaatacttgtgtcggtacttcttacaagtcctgacagcatcattcccaaggggtgcttgcaccaccaccccaatatcttgagaaaacaaggcatggcacaaaccacaccatccttccatctatctacaagtatatacatctaattcacctttctcttttcctgaagagcgacggcatgagctcgcttggtgaaagcgtccaccatgacctggctcacagctggcgcaaactgagaagataccatattgtacattgcatttttgaactggaactcgaggtccagtttcacattgcatgcgttttcagagatttggctgggggagattgtccacttcgagtagagcacattgaacatggagtggtccggcgctgaggactgcgttagttaggcaaaggaagtgacgggatccagatcatgatgtcaacaagcgatgataccatgtctgcagaggagacaggacggataacatcatgtgactgttttaccaggtgatccaaaagtgtcacatgtcatagaaccaagctgatctggcagatacagccatgtaaagatacagtaccagtatcccgcaagatgtgaagtggtatcatgtgacacggggcgatggctctggtggtatcacgtgattcaaatagtccgacagcccactgacatcacgtttttcaagtgggatcatgatcctaagggtgtaataatacacacgtatgagacgtggtcttcaaagcgccatgatacgacattggatcaggcacattttccaacttgtgattgtttacctatgatgctcggaatcatatggctttgtcatgtgactttctcatggcgatactcacaacaacgctcttatctttcacgcattcaattttgctggcgaattcctcgttgaattggttccagcccacctttagcaccgcctcgaccgggtttccgtctccatctgtttttgtgattgtcgagccttcgcaaaagggcacaaactccgagtagtgttggacgtcggagaccactccgtagatgagacctggggggtagttgaatcgttgtgtcacggaaaaggtggttggttcattggagggaaaggagaagaagtgccgacattggtagtgttgcgatgcagagagaatggaggtggttcggcagcgtagaccggccaacatgtcgggtttatgatgctggtgttggttgagatgtctggaagctttttgtcacagcgcaatatatgcatgattggtggacttgtgagagacaaatgtgtgagacctagtttaacaattatcccaaccccaactcaactaatctcccaccgccaactaaacccaactttagctccgttcatgcacactgattaaataaatctcagacacggcgcggtcaggtcacaccacagacacactacgatatcttcacagccagcatgtccatcgatctagactgggatggaatgatcaacagtgatgagatcgatgttgccgaatggctgcgctcgcttctggacaagcagttccagcagctcgacctgcctcggaacattcggtccgtgtccatcaccactctgagtcttggaacgatccctcccgagctcgaaatcaagcacatcagcgacccgttccccgagttctacgcggaggaagaagcggctgccgactcgcactacttgccgccgttacaccccccgcaacagcgcagatcggcacccagcaccccccacatccacacaaacacaaccaacccgattgatcgagggatagcgtcatatttccacccccttggcagtgctccgctcatgtccgggctcagaacgccccttaacattccctcctgggccacaaatggacacacacgaaccagcagtcggctgcctctcaacacgccgattgaagccgaaatagtcgagtctgtgcgtgaatcaacagccccaaggacgccggaggaacgcgaacaacaaccggtaccggaggaccgcgaagacgatcttcaggtgctgtttcgagtcaagtacaccggtgatatccgtatcggagtcgaggctactttacggctaaactatccctcggacgacgtagtgttgcttcccatgaaactccatctgtcgcatatcaacatcaactcgctggcaataatggcatacattaaaaagtccatttatctgagtgttatttgcgacctggacgactcggaccatgctgtggcacgaacaggaagagaacgactcgatatcattcgtgacgtcaagattgacagcgaaattggacaccatgatacgaatggagctgccctcagaaacgtcggcaaggtggaccgtttcattgttgacaagattaggtcgctgctcaaggctgaaatcgcctggccctcatggatcaaggtcagcatggaggatgaggacagtgacgatgaagagggagaggaagagggggatcaagaagacgaacattagatgtatgagtcattggatggtacggatagggactaactgtatatagtgaagaacatttggatggtactacttttcaatcatattggtgatggcctcataacttttgtcatactattactgctacttgttcattatttaccattcttctctgcaagcatatcgtcgtatctgagaataccgccgagcagcactgaggcgcccttggagcactgctcctgagtggagtactcggcgggattgtgggaaataccgtctctgcagggaatgaaaagcattgctgtgggacacacataagaggtgtagcccgagtcgtgtcctgcaccggattgaagacgtcggtaggacatcttttcgtgcttggccgacagctcgagggccttctgacactcgggatcaaagtgcagggcaggagaggtccatttcatggagtgtgtgaaggtcacgtctcgctttttggcaatctcctccagcttatcaaagacggccttttccagctcgtccaccttgctctcgtccgtgtgtctgagatcgatagagaagttgacttctccgggaatggtgtttgtggactggggcagtgagttgatgattcccacggttcccagacctcccagagaaacggccgtctcttcaattgcctggatcatggcagcagctgccaccaaagcgtcacatcgtcggttcatgggggttgttccggtgtgggcctctcgtccaatcacctctgcgtcgtaccaccgcatgccctggatacctgtgacgattcccacatccttctcttctgcttccagaatgggaccctgttcgatatgaagttcgaaatgggcagagaggggcagatctttgtagctggcgggggtggttcccttgaatccgattcgttccaactcggtcacaaatttggtatcgggttcgttgacgtctcgcagatcataggcgtgttcttgggggatctttccggcccacacacccgaggaaaccatggccttggggaaccgggcgccttcctcgttggtccaatcaatgacagcaatgggtgcataggtggtatgatcggcttcgtggagagctcggatcacctcgagaccggcaatgacaccggcaattccgtcgtatcggccgcctcgaggctgcgtgtcgagatgcgagcccattccaataggcggaatgtcgttattctttccaggtcgaaccgcgaaaatgttgcccatggagtccacagtcactttgcagcccagagcttcggcttcggcaatgaaccacagacgcacctgtttgtcgtcatcattgagagtgagccggttcattccgccgtcgtcggtggcgccccattgacacgactcgtggatcgagtcccagtatcgctggccgttggtttgagcctgcaagtatgtctgtgcctgaactgttccgtccatgctgagtgatagtgtttagttgcgggattttgtattgtcttaggcggacgtaattgagtgtactacggctgaacagatcagactcaacgatcctatttatatcggactctggatcgcgttatcgagcgggggttatcaaggttcgagtatatttagccgcggtgcagagattatgcaggcattcgagtaccgaatggggggccaaaaaaggcgattcatggcagattttcttgctgagaacgctcaattgacaatgtctcggtgacgaatttgaacgtaagtgattttctagtccacatcttctctcaaatctgttccgtggtacccctagttttgcgaatgaccagtacatactgttgtaattataaaggcatcgtgatatttcttgtacaggtacagtacatgcttacaatgaactgatcggaactcggttatgggacaagaggggctggaaatagccgctatcaatgctttaatgtacaaatgttcaatcactcttgcaacgacgacttgataagacctatgtgcaaatctaacacgacttctatacgagcaccaacaaacctacaagagctacagtatgataatcttggtgtgtcaagttagtgatgatagggagatcggaggtaatgttgagtatccgatacttgcagtttcttgagactcctgagacataatcattcgacctattgttttccccatgcgaacccacatccaatcatacaccgacaaccactgtagacagttccatcgccttatccaagccgttgagtcagacagagttagacgttgggattgttccgaatgtactgtagagttgaatggttgttattgggaatagcagtatgttttcagtacgatacttgcgatatatctatgaccatgtttgcaagtgtctactgaaccagtacaagtatatctacacggtacagaatacatacacggtacctacatacttagtctgaccattatgaaaacctacagaatgagtaaactgtacagaatagacccttctgttcatctgggcagaattacctttttttcagagtatgttcttgtagctaatattgtatcagctatataccccaattagtgactcctttattttatacatttctggcgatttattctgctcttgttgattctctttattccaacctcgatgcataatgcacccctcacagatgtcgaaatgtaggatgttcgagaggaggaactgtcactgaaacggtgtgaattttgaccgttgacactttgtgtgtctcagaacacttgtcatcaaatttatacgagtgctacctcttaatacgctcgtaaatagccgtaattccacgcaaatccaactccacgaattaaggttccaagaggtgaggagaagtgggggtcaggctgtggaaaatcgggtaaaaaacgctcttgggtggttttttgccttgttgaaggcgttatctcggctcggtcgtgcgcgtggacgcagaggctccactcttggcgccatttagccgctggactgtgtgacgtttcggtgcaggagtgacagtgaatagatatgatttggggtgaattaggtgaagtgtggagaaaaaaaaatgaagaaaaaaaatggaaaatccaaatcaatttggaaaaatctataataaattcggggtcaattattcgtgcttctacaagtacaagcatctacggaaagtcccccttttaggccataaagacccgttttgcccccgctatacgcatagaaccacgtccaataaataatatatacatgtacaagtatctaaaagagctcggcgaggagattcatgaccccagaccaccgtcgtttggtgaggatctccatgcacagaaccaggaagatgacctgagtgatgacccacgtaagcagaaccagcgagttgatgaccaccgttacaaacaccaccgtcaaccacagattgctgtctgttggaagccacgagacatgctcagccaggtgtttgaggtacagatgtggtggtgaggcgctgagatactgttcgatcgacccgctcgacgtgttgacgaaaatgtggaagatggcaatatagaaaagaagaaccactccctttgcgatgcctttgcggacctgcaagttgcggatgttgggcatgatgtgtgagatgctagatgtgtgggatgtgtgtgatgcgtgtggggggatgagatgctggtcgtcgtctggacgctttttttttcttcgtggatgtgatttttgtttcgaggctggcccaggtcgctgttttcggctgcttttgtgtccgtgtccgtgtcgtcgtcggtttttgtaagtgtcttgtcttcttgtctgaggtatttgatgttgctataccgacgttgcgccaggtgcctgtgacatgcacgatatgtggggaataaagcgataaagccgagttgttggggaggtgtgctttggctgctaaagggctggagacgtcgaggagagtgtcgagggtggtcaataggaatgagactagtttaagtacggttgtcggtgacaccaacgacactgccgtctcctttgctgttatatttttccttttcttcttcaggctttttttcttccctgctcgcacgctacttttggtcgtgctataagtgtgagtttattccccagttttatggttgaggttgatggaatcagataagtcgagaggacgtggaaaaaagaaaaaagaaaacacatttacggaggaaatatcacattttgagactcatgatctgggtccgttcgttgagtggcggaaaaaagccgttggccgtagttctagagagtccgtcgggccctcgtcaccgactctcgaacctcacaacgttactagctcgcactaatgcggaaactactgatgcacgtgtttactgcgtttccacaacggcaggtagagagacgcagagcttcatggagcagctgcgagcgcgagtacgagcctggtgtgagcagatccgtccaaaaaaacgagcattttacgactctgacagccatcttacggccggcgtcccttgctatactcgtcgaatgccacttggcgcacttcccctccccctccgcccctattaggcgttgactggggtggcgccgtggggaagtgagtcagaaggtctcgggacagcgttggaagcgtgtcggacaaaacccttgtccaagacacagagcgactgtacgacggtcccgatagtaacgatccataaaggccaaccgtaagacaatgggacgtcgtattcgctaccaggcatactacaagtatgtacatactgtgcgatactgtactgtacctacgatactgcactcagtgacaacgcgctgtagtataaacagacaaaacagcaagataaaaacattccggtactttctataaagccccttttttttgttctctgatttaattagtgcatttcactcactcctctccaccatccacaccctggaacctcggaactttgttggtgagcttaaaatcgcgtttgcctgtctgaatccacctacaactttaaatgccaactcaaacacaccaaccccagattcgaacacacgacctcccgtagtgccaattgggacagacccatataatcaagttacccggccgacccgtcgctaaaaccccagcgttcattggccaaccgatattagagtaggccaacattgcagcgaaatccacaccttagtaacaagacaccaaaatgttgcctggcggtcccgtccctgttttcaaggtgagtacgagcggcaagagacgagggaggtggtatgacggtgttggactgttcgatggggaaatcacggcttctccacatgttctgcgacatccatggcccgaagttgtgtcatgatcacagctgaagagatgtgactgagaatggaagctacaaaaagatgtgacagggaatggaagcgacaaagagaagcgaagggaatgaatatgatatggatggatccttttaacacgagcgaccgaccaaacacgacctgaaacaacacattctactactcgaaaaaacaccattctattgagataacaatgttgtttacggtaccacaccatatctccatcacacaccccacacccctttcgttacaattctaacccagaaatacacagtcggctctaagggtatctgggagaagctccgagttctcctggctattgcccctaaccgatctaccggtaaccccattgtgcctctctatcgagtccccacccccggttctcgacccgaggccaatgtctaccaggatccctcctcgtaccccaccaacgacattgccgagaacccctactggaagcgagaccaccgacgagcatacccccagaccgcctttttcgatcagaagaccgtgaccggtctgctcgagctcggctctgaggctaccccaagaatcgccgacggcgaggctggaaccaaggcccttgccaacattgctaacggtggtgtttctttcacccaggccctcggaaagtcctctaaggacgttatctacggcgaggtgctgaccgtcaacggtctccctcccgtcgcccccactctggctcccaagcagtggaagatcattgagggcgaggctgccatctaccccaagggctacccctgccgaactttccactaagtggttgcatatagataagttatgaaaactggaaaaacgagactggaagagggagagagagagagagagagatggttggtgaatcttgatgtggaaaacagtggagatgcatgcaatgacttcaattctggcacattacgtagctacttgtatctgccaagtattgagcaggtcggcctctgttcttgcaccactcgtgtagatcgcatgtatacaaggacgtaaactggggatgtgcgactcggagagaaagtggattccgatgaactttatgaagtgtcatgttggggtgtttgtgttggaaaagtagtggttagagtccttttttgtgagttactgtagctactttagtgtcgaaatcctcacatatctgcaaattgagtcggtattattttttccgattttacccaatttaatacgaattaatacgaattaattaataattatggataatcccctttaattgaaattaaacctactcccaaccgcttcagacacggctttccgaaccggtgagtttgttgagtgaagcgaagtggatccgaatcttcaagtaggatgaatgataaatagatcaacctgtcactttgtaaaatgataaagtgagtccttccgagtagaatgcacttttcggattttccacacctgctctacatcacgagatatcaacccacccatgcacaaccccgcaactgtatgctctccccaaagttaatccgtcggatcaactgtggtggagccaacactaacaagctaccaatacgatataagggttagctcccgctctccttcatcatcatttcttcatcaatgtctgtcaacgccacgtctctctcttcattcaacgccaaccacgagctctacgacaaggctcggccttcgttccagcaggatgccgtcaagtggctgattgacactgctgggctgcacaagggctccaaggtggtggaactggccgtgggcaccggcaagttcaccaagtcgatcatcaacaatggctatgatctggttgcggtcgagcccagcgagggaatgctgacctccttcaagaagaacttcccccaggtcgaagccaagatcggatcatcctacgagactggcattgaagaccaatgggccgatgctgtcattgtggcgcaggcataccattggtttgccgaccacaagtcgcttgaggagctgcatcgaattaccaagcctggaggaaagctcgtgttcatttggaacattgaggtgctagacaagctgtctccgtctcactggcagaagatctccaccgaaaaggtgtggtcatacgacgtcaacgttccgcagtaccgccatgacaagtggcaggattctttcaagaaccagacgtggttcaagatgccctaccaggaaaagattctgccctaccagctgagttactcggacgaggacatgtggaactactgggagtctcgcagttatatcactgctttggacgggcctgagaaggccaaactgaaggagttcatcgagggtgttgtttccaaggctcccaaggaagaaagagattctgagggcaagctggtggccgaccgaggtactcatgtggttgttgccacgcgagtataaacgagtaagagtacagtacgaggagaagattgaagtactaaagtgaacaattgagtaatgagaaagtatgtgctccatcattgaggtatttgaacaagtagctaagcatagcttgccagggcggtcatgggcgatcaacgtatcagcaagacttgtgttttagttcaattctagctgcatgtcctttatgaacgagcattgtatttagatagtctacctttagactgtgtatattttcaatttattttaaattttaaatttctaatttttcgtttttttcatccttgttaccgtcaactaagtaattgtaatgtttcagttgatatttagttgaggtttcaaactttaccaacatatgataactcgccaatatctgctccaaggcaactgaaatttgtacaaaattttcctttgaaccatttaaatactttcaccgttttaatctgcttcagcatgaaaattgaccgttctagagcctctccatctccacctctcctacatcgtagagtttggacacttttatgctacaactcacagttgaaaaaggcactctgactcgagcacgggtatgagaggaatttcgacggaaaaaagaaacgcaataaatgaattattgtgactgatttggccacaaatggacatctgatgctcttaacgcgctcgatgcaatccctcgggtccctctgagttgctgcgcttactcagccaaatttaagttccaacactgacataaaaaaagcgatgaaaaatctcttaccaacacaccatcacaatgcgacctattctactgcaaggccacgagcgacccctgacccagctcaagtacaaccgggagggcgatctgctcttctccgtcgcccgagacaagaccatctgcgtgtggtactctcacaacggcgagcgactgggcactctcgagggttctggaggagccaacttttctgtggatgctgatcccaccaccaccattgtggcgactggctctgctgaccagactgcgcgtctgtgggacatcaagaccggcaagacgattcatagctggaacttcaagaccaccgtcaagcgtgtggagttttcccctgatggaaccaagctcattgttctgtctgagaagatgatgggttaccccggtggcatttccgtgttcaacgtcaaggccgacgtgaacgccacccaggagacggagcctattatggatattaagcccgaggagggcgccgacaagttttcgtttgccgtgtggtcgtacggaggcaagtacatcatcacagcccacgctgacggctctctgtccaagtacgacggagccaccggcgagttcattgcttccacacagatccacgaggagaagttccccatcaccgatctgcagccttcgccagacaagacctacgtcatcaccagttccaaggacaagaccgctcgactgacagacgtggactctctcaagctgctcaagacctacaagaccgatacttccatgaactcggcatgcatcaccagcaagaaggactttgtcattctgggaggaggacaggacgccaaggatgttaccaccacctcttctcgagatggtaagtttgaggcccgattctaccacaagatctttgaggacgaggttggccgagtcaagggccatttcggtcccctcaactgtgtcgttgcccaccccaatggcggctcctacgcctctggaggagaggagggatacatccgaatccaccactttgacccctcctactttgacttcacctacgatgtcgagcggtttgctgctaaggagtaaatggtaggtgttatagatggataaaaaagaaaggtctgcgaagccagctctttagtatgtaagagaatgagataaagaaaagcctgcaagaatgtacaatgagaaatttgacgaagatgttagctgttgtggatgactggtgctgaaactcgacaaagatagatatagaaacgagagtcgaatgcagtgtctagtgtagctctgattgaaggcaagttgactagaagctacaaatagctaaggtcagaagactgtcgcagggtacaatcaactgtgtgaaaggtcaagaaacgattccacttagtatttgaggtgtatttgctgtgatatacacatatactatcgttggtgatgaagaaactcataaacaggagagaatagcaatataaaacatcttcttgccataaacttgcatcatgagacacacattggtgcacacactacccactcatatctgtatatgtatcttttatatgtatagcgacgaccgaaacaacagtccaactcgtgactggggttcgttcttactctgtgaaatcacatcctcctagttcttaccctaccattgttggtagagttcctagattcctagtcatgacccgagcccatggcctcctgaatcacaccaaaatgaacatgggagggaaggcaactaacagctgctccatccttatcgtctcaatctagagcggcgacgaaggaaaagctagcggcggtgcgcctagctcgtctatttaactctctcaaacttgacctttctgtcctcgtccaacaccaatctcaactgccgattgggtctagtcaatagtgtctgctctctcagtccgggaatgtacatctcataggcaggcatgtagccatcgatgaacttcttgacctgctggtcggtcatgcctgttcctcgtttctggatcaacgcgtgttcctgttgcaaacgccacttgtaggtgaagtttatgtccagcgagtcaaggtgcacaaacgcgtcaaagtacttccacagctgctggagcttcttgagctcgtggttgacctgctgcagatcggaaaactggtggtgtgccagagtcgttggcacgggctccttgagctgatcaatggacgaggcctcgagattggcgggatccactgccggtgccgcgtcgggatctgtctcgtcacgcgccagactcgtgctctgcgcgtacagagcctccagctcgtcgatggagatggctcggaagccagcacaccagccctcaaacagcaccacgtcaaaagggggcgtcatgacgggccactcggactcgggcacgcggtcgccctggccctgaaacttgctcttgtcgtaccgaggcacgggagtcaccttgttctgtaccaggctcttgagggtcttttcgcccagagcgacatcgtgggtgccaggctcgcctctgtgtcgatagagcttgttgttggggaactcctccgacagtcgctcctggccctcgtgcgtcaggtacaggtcgtccagcgacagctcaatgaccttgtagttgaagggggcctgtctcagagcagtagacagctcggctaccaaggtggactttccacagccctggggcccggaaaagccgagcacaaacggcacgttggcggaggccgagcggtgggcggaaatcagcggccgcagaaacgacacaatcgagttgactttgtctgtgttcatggtgatgtgcggtacaagtagttgcaacgagattgtagtcgctattgttcgagtactttaatacacggtgaaataaagtgtggcccccaacttacccccacgaacaacacgagccgaccaaactaaaaaccaccattctagtctggagaattgctttttcgttgttgggggagagtagccgggggtgtcgatcacgtgctgctgggcaattggtcagatcacgtgaacaggacttgtgtcggtgggtctctgcagtgtgacggtaccatatcaatgtagtacaactacgcaatcgtaccgcggcacacatgctcgtacagtgcacaagtatcaaacgcgcgcgtgagtgattatgtaagtcttcagtatggacattagataatcacatccccgttacgcacgcgtgggggggttaaaatccacggccaaatctccacattccccgtaccctgtaaaacgcccaggtatatagacattttcaacctcccggcaggtcccctcggctattaactttagccgaggaatagacccgcgagtttaaccaggaacacgatgacagcagttataggtgggcaacattgtgtgaaactggcattggtactcgtatgaagtcgctgactaatcaattggttctaagatggtcaaaaaaccatcattatttgacacgttaccgtgtatactccacggtattatgagcacatgttcaatcattttgggctgatgcagggggtcgatcataaacgtctttctgtcgtataattaacggatcaagtgacctaatgttgatgtttgactgaacgaaggctgtcgtttatgttcgatacattctagtgatgtcaatgtcgtacttgtacaagtgaagtacaagtactgtactgaagtagagaatgacaaagttcccataatcacggacctgttgtatgatggtttgcgaatctacaataggtgtatgattgcatctggttctagaggtacaagtacagtttattgtctctatcctacagtacaatgcaggagtttatagcacattccattgagctgctgtagagattgcagtcggtaaattatggcggtttagtgaccttgatggatggagttagcatactgtaatgttgatgcattctggtgctcatactaccagttacacagaacgttcccattcaatcaagacagtttctgagaaataactggttttactgtacatactgtatagtggttgtactgtcctatacctattttacatacggtctattgatggatccaacattggataaacagtctccttggggcaattggggtaattgaggtttgagatatagagggattactcactggaactgacaatactcgaatggtgactattagacagatactattgtttccagacattgttcctgggtaaaagttctcagattcagacgggcaacctctctactcacgttgttcctgtacctgaagctggaagcgataccctcactagtacactgacaacttgtttgttcgcactaatcttctcatcttctcattccctctgagagtatagtggcaactacaagtactgtacagattgtactgtatatattgtagcatcgttactggccccacagctgtaactgccattcgcaccaactcttacggtactcctgtatcaactaaaatgtccccatgagggaacagagattctcataaactccgacggttccttaaacaagttgcaatgaccacagtttctacacgattcgcgccagaacccgtagttagataagacactgtccaggaattgtttgagcactcatgcggatggaaatctgaatctcacaaacactgatggtgatttattcgagctgctgaccgtggctgagaccaccgatacttgcattgttcagggttccccgtccatctcgcctacagtacggtactgcaaaaatcactgtttttgttactggtggctcaaaggtaagtctggagtcaccggctctgctgtcacatctggacgcactgtgattgtctatgtcaccattccctcttcttcaatcagtgttggaggtggctctaatgactctgaagactttatttcagtgccctactgaccgttcacgatcgattcaacaagctaaagtaacgacgcttcgtctttctcagtcggtattcttctgatccttcatttggtcaacatggactcatagactgacatggccgtcttctgtattatggtcattccgtatgtttttctcacccctcttcccagctctcaaaacaaaattattccggttgtgagtgaatcggaatcgattaccgtctgttaataactactttctgcctattgtattaatatatatatatatacttatatatacaggtattcagcggtgagatatgttgttcagttctcaaaggagcgatctaaaaacacgacaataaggatgtacagtagttgacgtactcgccatgattccgtggaaacaagaaagacggctaaaaagttcatctaacggttccgtgtggcaaaaaactgctaaaaactgctaaatccatatatgcactgtacgtagtttccacctatctcgtcttgctgcagattagggtcccagcgctggaacttgtaactgaccatatccgtccccggcaaatacctacaacagctgacgcaaaaagatttggtccctagcaggatcgaactgctgatcttcgcgttgcaaagttgctatttcttattagcacgacgccttaaccaactgggccaagggacctgaagatgtttcagcggtggagatctttaatttgagtttaaaaatggggtccaataagtgaatcattagaataaaaaaaaaaaaaattcattagcagtgaatcattagaattaaaaatatttatatatatttatgtctatgtcggagtttatgtgatcttttgtctcatccaagataccatggatgtcatgaaatgacgttttacatcatttacagctactgtcgctttgcatctcactggcgccttgttcatggcactctcgagagaaacctgactatgatacaagccagaacgtgtgaaaaatgataattatactccctttagtgaataggagctccaattgagaccagtattctgtttcctttcctttttttcgcacggcctctgacagaacccccacgttgagagataaacccacctggacataaaccacctagagacataaacacaccttgagatagttctacgaaaccatgcagttatccaaaccaactatgtgagtgactaaatgtataatatcatatctagtcaaataccatggcatatatcttgtttcagctctctaagccatgacgatgagctggaccgtttggctcatcgccgtcctgaaccttgtatacagaacagaacagtagaatgtgttcttgcagagacagtgacgaataaattggtcacatgagacattcaaatctgatgtatgtcttgggatacaaaatccggtacttatacagctctctcaataaacaaggagctctctgaggaccatgtcttgtggaggacgctagtgtggaatgtgcatgagaactgcaagggagataagactcgaaaaagtggataatctgaaactgtgaagcgacgaatgcacctaaacaagtttcccaggtcagtgattctgtctcttttgactagtttcagtgatagaaatatcaatggaggtgtggtgttcctctgtggattgccaacataggaccgtttctcataaacccactccctagactgtcattagtatgtgacgtaaaatatgacttatgagctatctgaggagattttctccctgtaagattcatccacgattgtgctactatacggcgaatcgtagtcacttgttaaaagtccttcctatctggtattaaatatataaaaattaaaaggattactccttggtggctgcaacagtaaagtgaatggggtccttacaggcataattgtcacccttcttcacgtagacgacctggccaccgtgaagagggtcatcttcagatgtgcaggagtaccactcgttgactccatagtaggtgacagacttgaccgagttctctccctcaaactcccagccaccgttgtagccctttcctacagaagcagggtgctcgttgatgacaagctctccgttgtcagcggcgtatagctccttgggaggctgcccctcgctctcgacgtttacaaggttgtcgccaacagcctccagcttgaagtaggagaacccctgggtcagtccgtagacaatagagtctcctcggacctggagggccttcattcccacagctccctggccaggcatgatggcgttcagagagtacttggggttggagttggagttggagttggtctccacgtgctcctggggctgttcacaggcaatgggagcagcaagggcagcagtggcagagatgagaagagtctttaaaagcattgtgattgttgttgtagtagtagtttgcagatgttatgtgagggaatgaaggggatatggagggggtctatatacttctggggacaccatttaagtctataacttgctcctaagatgacgtcgaagtcgataacatctcacatttccaatgcaatgccgtgtggataacgacgtcacttgtagaagatctatttagagccgtgcagatgagaagtgtttgccgatgcctggtgacttaagcgaggtgggggtcagatgtggtggtggggccattctgaagggcattcgaagaagataaaacagcaaatgctaattttttagcggtttagagacttctcaagtcatctaaaaagttgataccattggtattgatccagttgtcgccatgtgtcctggaatattccgaggcatttaaggttggctataattagaaccgttgaaattagcatgcataaataaaagttcgacagttcaacatgacgccaactccacatgagaggagcatccaagaatagacctggtcagctgaacgtgttgctcgatctcaatctcttcgatcagggttgggagtttgattgtttattagagcatcgaacattctgtggagcaaagctctatatgagtgagaggtacgagcaactagaaatgcccttcactttggtgaagaactcggtcttcatttctcgtaactgcaagtgcaaatagaattaaataccccctaattatagtgtcaccaataccgagttattatggtcattgagttgatcctacggagtcgaaggggagtttgatagcacttgcgaagtcaagttcatatcacgtcttgagttcaggcaactattttaccgaaagtccactcataatgggagtatttgggaatcaaaccacccaggctaggatctatcttcgtatagttatatgatctaaaatgtatcatctatgtatcatctagcatgtatcccttcagtatagccccttgtgttccctttggtgctaatggatcactctcggggagtttctattgatcattagactggggtatgataatttagcataattgtacaaaatacagtatgtactgtacgtacagtgccgtacaatctgtacatatcctgtttgtctatttcgttctatcgtcgactggatgttcaggtgtatatgatgcgactagacacatgtgggacatggagagagctgttccataaaggaatagactggagccccattggattatggccattgataattaacctttccaactgtcaactactcactcaatacaagactatagtcagtatgtcattattctcatttttcaatcagcttccggacacaccaatcctgactcagcaaacaagaaaaacatccacacgagaagcaaaaaagaatgagcggtaggggaattgaacccctggcacctgcttgcaacttcttggaaggcagatatgttaccactacaccaaccgcccgaatggtggggtctgttagggttcggcggctaatcggccgcggctaaacctgatactggaggttagtgatactcgatccgtcaccgcggctattcgtgctcttgtgtgtctgttgtttccttgtgagtgtccaatagtctgaactctctgttctacttgtccatggttgtctgcctttgtacttgaccgtttaacaaaggttagtggatattggtccaatattggtccaatatgatctagcggataacctacgcactacgccgcttggagagcactgcccgtccggaactggaggagttccggaagttgcggacgccgatcctgagattatataacttgccctatttcctatattataatgcaccaacaattgttctgacacttcgactactaactaccgagcttctccagtaagtactggttgggagcccaagtcctgaggccctgggttctaacagggtcccagagttgtatcgactataagacagtggaaatgatcaaatatccggcgaaaaaggctagaaaaaagagagaaaaactgtgtaaaggggtaaaatcagtaatatacagtactatgtaaagaattattcatagtttttttgtctccaatgaatcatctcagcctccaactggaacactcaacaaggaataaacatctctaaaattgataccaaaataaccacaaaaaatgtgacatttcaatgaacaaattcccatcacgtattttcttcaaaaattcgacccttgatctccttctccgctcccgccatttcatcttttcaatttcccttatctcctatctccgatacgagaaccttatttgcttccatccttcaagcttattaatcatctcccagcaagcttattttgtcccgtcacgtgagagtgaaattttacggttcccaaatcatcaccgcgacatcaaaaaccattcaacacacaacacaaacatctccacacaatgagaccctcgtttgtgacccagctgctgcgaccatggaagaaggaccgttccgggtacatgttcaacctgttctacggtgtgtcgaaaaacggtaacaagcgactgccccttacctccaagcagggtaacaagaacttctacaagggccatggagccggtggagtcggtaagaccacttccaagggtcgattcattatcaaccgagacaaggtccgaacttttgtcgttcctgccggtctggaggcttgtgagctcaagccgtttgtgtcccccaccctggagcccatcaagaactctttccgaggcttctcgggtcccctcgaccccaagctcaccgtcaagaaggtgaacgagtatgtcaagtccggccctgttgccgaggaggatgcccccgatcgaaagaactggatcgatcgagagtaagagacgtgtcggtacgtgacacacaaacctgaaggatgagcgactggacacgagtcgaaaccagaggaggcgaaaattgtatatattgagcatgattcatgatgattgagaacggtgggagttagtagttgatgtaggtcggtgtagtgatagtcaacgtgacggtggtggtaagtattagatggtgtacttaggagtagagtggtttgtttcatcgaacttattccaaaagacagaacttgttgtatgtgtacatttgtctttcaatcgcttgttttctacatctagagtctggttttgtttttcgagaaattggctaaaaactgaaatactgtccagttccacgcagaatagatacaatacagttggatttgatttattatatttttcgaacgtcgaatcttcaattcgatggggcaccacacacttctgttcataggccaattgtagctgatccacaggccccattcggctgagcactaagcccatgtgttgcgatctagagtgacactatacattatgatccatgttcatgtcacgtgcggcggaaagcgaaagcgcgaaacctgctaacaatgtcgctccacacgtgtctcgataactcgataactggtccttgtcatcgtatttgttgcacctctcttaggcgtagtacctgggttagctcattctcgcttctcactcacccttcgtctcctctcgtactcacagttccaggtttgatccgttgtggatctcgtagtcatccagagtgatatggtccttgaaggtctggtatcccttcttgagcacaatcttctcgggagcagttccgatctgggctgccagcagcttcttgaagtcgccaatagtgtcttcaggtagacacttgacccgcaccttcttgcccacactgtgttagtcatgttggtagatcaggaaaaatagatactcaccgatcgttgcaagtgatttcaatcatttctgggttcctgaatgttggatgggaatatttgcaacttctctgatgtccatgcacggagatagtccagtatagttaagcttttaaattcgtaaatatgtttttatggagtgttaggggggtgtcaagtagagggtcattagatccacttgaagtacgagtactgtgctcgtggttgtatcattaaaatgcactttccgacacaaaacagtcttttccggatatattccgacttttcccgccatttctggcttcccataaaatgctttctatcggatcatattcagccaactcgatgctccaaactttgtaaaactatctcagtatgtacagtacactacatacaacaatatacacaaggcaagccacctccccatatcacatcattgataccattgcataccactcgcaccactcataccactgagcattccacgtgatcatctcatgaacagcaagtttgccacggtctcatcgatacactgaacaccagcccttctgatacctccaccaccagccggcacttgtggagacacaaacccggacccacctcacgtcgcgcgccagaatgagtctgtttgttcttgctctcatttactgcgttacgtttattctcctctgtttctggtgtttctggtgatctccagcgttcacctgccacctttttgtcctcacctgacaagatatacccatcccgcacacaataccaaaacacagtctggcagctacaacaatacctcttcttttcaacaacactttcagtgctcttcactgggtggagaaggatacgccgaggatatatgatacccaccaacaatcggcttcgaccaggcatggggaaaaacatcattctctgcctggatggcacgtccaacagtttcggagcaggtcccgaaaccaacgtcctcaagctgttccgcatgctcgaaaaggactcacccaaccaattggtttattaccagcccggaatcggaacccacatcaccgtcgacctgcccaaaaccatctggtcagcagcatactcatacgcagaaaaaattgtcgacattggaatagcctggtcccttgatgcacacattattgccgcctacatgttcttgatgaaacaccattgccatggcgaccggatatacctgtacggcttctcaagaggtgccttcaccgctcgaatcctcgcaggtatgctggaccgagtcggattattgtctccaggccagaacgaactggtaccttgcgcgtgggaaatctacaagacgtgggaagcagctggtcagcctatggaagacaagacgtccaacctggcatgctctttcaagtcgacattcagtgtcccttctgtgtgcgtctacttcatgggtttgtgggactccatcaacagcagtggcattattctggaccgctcgttcccctacacctcttcggcgggtatcgttcaccacattcgacatgctgtcggcattgatgaacgacgagccaagtttaaacagaacctctttgtccctcattgctacaacccaacactttttggtccttccggcatatttgccgagcgtcagagccctgaactgactcctgagacaagcccacagaccagtattgtttccagtgtccgcgtcagccctgttgagagtcggcagcatacacccaaaggatcgatggtcatactgagacaccctacttctcctgtccctatcagtgcgagcacaccggttcttgcaagtggatcatcaattcgaaccacggcttcaggacgtcgatttccttgcagcagccgttcagaactgtcccacatgttccgtgctcactctgaacaatctcatatgattgggacacagaaaacacgccatagaccggagcgatcaggagatctcgtggagttgtggttcccaggtgaccatggtgacgtagggggaggatggttacctcgagggtcaccacatttgctctctgacattcctctggcgtggattctctccgagagcgtcaagtttaaggtgatctttaaggagggagtgattgacgaatttcgaaacaaccatgatcccgaagagtgtcttattgcacccatgcacgactctctaaatctctttcgacgtcagggagaaaacggtcgtggagaagatccttggtggagaccgtggttctggtggtttcttgaaaccatgccggtcgcttaccgggttgagaacgaggaagagaaatggacaagggttgcagttcccaattacggtcgggcacggaccattcctatgggtgccaaatttcattggagtgtggcttggagaatgaggttggttgacggatatcgtccgtttgatcgttcagaggatgatgacggttccagtgtgactggcggtggaagtagcagtgacgaatacggtgctattcccgatgactttgactgtcatgatggttgctaggatgtagttttatatcctgtagtatttatatttcttgtgtcaatttacttgtactgggtactgtgtcaaagtcccccgtaagaatcgaacccccgaccgttgggacgcgtttaaggttgtcgctttgtatggggtcggaacaaagcaggcagcaatgcactgtgaaatcagccaaccaaaagcgaaacgataatgcggccgagggagtgcattcaattcggtcaattcgacaaacaggagacatctggccggtttgatgggataattggccgattattctcgattaagtaagcaaactcgtcgagatttgtgcatttttggccttgtttggcaactcgtcattttgccaatccatacaccgactgcagctttagagatggccttacctcccaatggcttttggagttctcccaatggtcaaacaaattaaggttttcagggtaggggctcgggtggaccaatcacagtggcgaaatatgcgctgcgagggagtttttgcaaaagctaacatttgcacgtaaggtcccaagtcaagcacacaccacacttcaacctctcttgacactcaccctcgactgaacaatgagcctgcttcgaaccgccgcccaggccgtcaaggcccccaaggcctacactcctcttgtggccgcaaaggcctttgctcagacccgatctgtctcttcacagcccattggtggcaagtccacatacaagatccccgacttcactccttacctcaagaaggaccgaaacacagatgccaaccgtctcttctcctacttcatgattggatcgtttggcatgctctccgctgccggcgccaaggccaccgtccaggacttcctttccaacatgtctgcttccgctgacgttctggccatggccaaggtcgaggtcaagctcggtgccattcccctcggtaagaacgtcatcatcaagtggcgaggaaagcccattttcatccgacaccgaacctccgaagagattgaagaggccaacgaggtcaacgttgctaccctgcgagacccccagactgacgacgagcgagtgcagaagcccgagtggctggtcatgatcggagtctgcacccatctgggttgtgtgcccattggtgaggctggagactttggcggctggttctgcccctgccacggatcccattacgacatttccggccgaatccgacgaggccccgctcctctcaacctcgagattcccgagtacgactttgctgacgccgagactctggtcattggttaagggatataaaagtgcatgcacgagagtgtaataaatttataatcgaacgactgacaggccagtgcgatccacgagtctggccggtgacacgagcaccatgtagataacacgacgacaaatgacggtgacaagagcatgggcggagtttgactgatggaggatgtagatctggatttccgctgggatgtcagtatgaaatgctgaaattctaccgagtgtcctcgttatcgtgtggtatctgctatatctgcaaaggccatgctggtgtgttgtggttatcgtgtgtggagtgtagatgttgggtttcgctgttaccgtgtgaatgtggtagagggatcgctgataaaagtatataaggggatgctaagttgcacaatcgtccatctcattttcttcacattatcgagattccgtctctaccaccatgaccgccatcgccaccatcttaaagtcccattcctgacatcacccatgacctgctgattcagagttgcgtctcgagaaccattggtcactgggaggttgtctgaccaaataaagttgcggaacaacacaacatgggaggaaaaacacgagaggagctgagcgggacgtcgttcgagaggacaggagcgttgacttatctgtttggaacggttgtgaatgttgtctgcatcgcagttttagtcttccagtccagtgtctttctcaatgacgtcatcgtctcgtccatccggctgcaaacatagggggtaatccatgttcggctatcaagattaggacgttgggcttgtcacattagaagcaacttaatttgactgggaaatggagtgacaaaataaaatgaagttagaggaggcagttggagagctggagatggagcaatgaggtgagaccgaaagacgaaagacggaagaaaaaaagaaaaaaacagaatgacgaaatgagaagaaaagtgatatttccaatctttcttgaattgattcttggcggtaatcgtcgtaaattcatcgctctcatcggttgcctcacattacacactctgaatgggttcactatgttcagtcaatgaaccccaactgagtaagtgcagactttgaagatgcttgcaacggcttcctccagttctttgaaccaaccgcggaaggaagatgttcttcgtgcgtttacagtacttgtacttttcagcacctctctaaaagtacatcatactgttttttgtttttttctgcatccaaacgtccaataggcctaagtaattacatagtttacttggaatcagaccaactaaaaaaactccatttacttcaccagaaacaagactggctggaagagaagtatcgtatattgtgaagacagcaagactcacttgaaaaccgatgcttgtgagaacaggcaaaacgcgagtaataacatgtacgtaccgtaaaaacatccctgatacctcgcacggttccatcacgttcacacccaacgcaccaaaacacctacacttgcacccatctacatccccatatcaaatgccaatattaatatatatataccgggttcccattccatccttttacgtgcgagtgaacacctctacacccctaatcaatctcaatggccacagcagagccctccacagagtcctcaggaacaggggtgctggtggctgtgcttgctctcaccggcgtagaagttccagtgccggcattggatcctgccgatgccccggcgccgctgggcttgaagaagttggttagcgaaatgttgcctgtaggctccttgggcacctggacccctcgagactgaagtgatcgcgcaggaatggttctggggatgatgtcctgcagaaactcgagcttggggttcttagctatcgcctcggccacgtccttgtacgccaacgtctttcgctggtccattcgagccatgagaccagcctgttccgacaggtaccgcacaaagtcctgggtggccgcgttgatggcggcataggcggccacagacacgagcgacacgtcatcgtcctggttgacgattcgcttggttcttgctagaggcagcttgatgtttggagtcttgtcggcggcagttgttggtgtttctgtggacgctccggattctttgatttgcgcgttgttttcttcttccggggcctcgtgagtgtccacggtctcctccacggtctcctccacggtctccacctcctcgctatctctcatttccacgtcctggctcatcttcgtaatgttcgtattagttggaactgatgcgtttggctttatggctgatcgtgctgcatgacgtgttggcgtaggtaatcacgtacagtagggaatcgaaattgattttccaaatgtcttcaataggtgggagatctaatatctatatatattcgggaaacgtgtttgtgtaacttgtatctgccccagcacacgaccaatgtcgtgatttctcaatctgcaaatatataaacagctccattattcccacttttatttttattctactttacactcttacttgcagtctcactcaatctctacgtttcagccaccacatcaaagttcatgcatagacaactatcaatctacaagttcgactatcacggccaaaatgaccagaaggtgagtaccatgcgcacaaaacggctcacccgactcaagctaacatagacgttcggtgaacatctcggacgtgacggaggtcagaagatatgaggacttctcgaccatcgactgggtagatgtggctgccagagaaaacatgctgcgatgcctgacgattgaaaagttccgaccggcgtcccgagtcgcagcagggtcaagcgacacccgaggacgaattcgacacaagctctatgaggtctacacggcagctcaatcatggctggtactggccctcatcggtatggctatcggagctatagcagccgtgctcaacatttcgaccgagtggctcgccgacctcaaaacgggctactgctctacaggattctatctgaatgaagacttttgctgctggggcaccgagggagaccactgtccggcatggcagtcctggactggctttggactgctcaattactttgtctatgtgggatttgctgccggatttgccgccctggcggccttcctcgtcaagacctacgcaccttacgctgctggctcaggcatttcagaaatcaagtgcattgttgctggtttcgtcatgcagggttttctaggcccctggaccttgctgctcaagtcaattggccttcctctggccattgcgtctggtctgtccgtcggaaaagaggggcccagtgtccactacgccgtttgtgccggccacgtgattgcctcgctctttggacggtaccgaaactccaaatcgaaaatgagagaaatatactcggcctgtacggctgcaggtgtggctgtggcgtttggctcgcctattggaggcgtgctattctctctcgaagaaatcaccagcaacttccagatgaaaaccatgtggcgatcgtacttttgtgctctggtagccacaggtgtgctggcagcgttcaaccccttccgaactggccagctcgtcatgttccaggtcaagtacgaccgggactggcactttttcgaaatcttcttcttctccatcattggagtctttggaggtatgtacggaatctttgtcagcaaatggaacctgagagtccagtcgttccgaaagcgatacctcggcaagtacgcagtcaaggaagctactctcttagcgtccctgaccgctctaatctgctactccaacgagtttttgcgccttgatatgactgctgctatggaaaacctgttccacgaatgtgagaatggatgggagaagtaccacgatctctgccagcccgaccgacagggtttgaccatgctgctatctctcctggctgcctgcgtcatccgaacattcctggttattatctcatacggctgcaaggtgcctgctggtatctttgtgccctccatggccgttggagctacctttggacgactgattggaaacattgtacagtactggcagcaggcacggcccgactctatcattttcagccaatgtgtcgttgaccagccttgcatcactcctggcgcgtacgccttccttggtgctgccgctgcattgtctggaatcaccaacattttcgtgaccgtcgtggtcatcatgtttgagctcactggtgcgttgacatacattctgcctaccatgattgttgttggaatcaccaaggctatctctgatcggtttggcaagggaggtatcgctgaccagatgatttggttcaacggcttcccattcattgacaataaggaggagcatgccttcaacgcacccgtctcaaaggcaatgcagaaaaatgccgtctacttcacctacgacagcatcactctcaaggaggtcgagactctgctcgaatcgaaccccttccagggctacccggtggttgaatccagcaaggaggaccctcccatgctagtgggatacattgccaaggaggagattgttcggttgattgcaaagttcaaggctctgaaccgcgacattcattcatcggagctcggacaggtccaatgctactttggagagattcccgagtctgctagacagtcatcgcaagcattcatcgacatgagaccaagtatcaacacatgcccgctgacagtggcaccactagctccgcttgaaaacgtgacgtcaatcttcctgcagatgggccctaaggtggtgttggtagtcaaggaaggacgtttggtgggtcttatctcccgaaaggatgtgctcaaatatcaattcatcactgaacgacaacacaatcaccacactcgactgcaaacacaacagtacaatgagcagctcgaagaacgagtatggaagctgctcaatcaggcaggagactacattaaccacggtctcgcaaagatcaagggatacgtcctgaggaggtaattagagcgaacttccacacaaaatttaatgacgatatgatgacgtatagacagaatggataagtacaaggaagaacttgtactcgtaacttgtagctaaattgaaacaaaagggactatctatgtacatactctacgtaggatggaaactacgtgacagtttctacaaatacaagggagggggtatcacaatacaaatggagaggcgtaacgtcgaacagggagaagcattcaaacatgaaacaagtcgctaaagattcgtttggctgtcaaaaagtcgctctgttttcttcggtgttgcgctcatggactgaaaggaaaaagacatgtgacaaggcggggatctcggaggcctctcgtggtttgtgttctcgtaaatcttgcttgctcgcaaaaggtcgcaatctactgggtcgctccagcaggggtcggctgctcgtcgggtaaaaatcattggtgatacatttttgggcgtaaactatttcatcgtaagaaaaggagtgcaggcagggcaaatagagtcgaatcggatggaatcgaacagcatagtaatcgaataatagccaaacggcggacgtcggacttacaagttgtatgtacttcggtgggaacagcttcaggcggactttcgtaaatctgtgtctgtttctgtgttggggggtcagcgggagtgtcaacgcaccgcttaagatcggtagtcgtctccggctccgtactcacctcggaactcccgctctcgtgggggaggtcggctgtaccggtctcctcctcgctcgcttcgatctcggtaggagtcccggggctctcgcatgtctcgggagtctcgaggtgggggtcctcggtaatctcgggaaggagggtatcgctctcgatcccgatcatcgtaccggccaccaccgtagccacctcgctctcctcggtatccagcaccgccaccaggggcgccgctaccggggaatcggtctcggtcatcataccggggaggagggggtcgtcggtagtagtcctcttcgtatcgacggtcgtcgtatcgagaggggggaggtcgtcggtagtcgtatcggtctcgggagtatcgatcgtctccgtatcgtcctccacctcggccacctcgtcgggccttgggaggtccaaagtatcgaccgggggtgggggttcgggctcgctttcgcttggccttctcaatggcaagagtcttgccagcaagctcatggccgttaagtttggccagagcctcgtcggcgccggtaacgtcggccatcatgacgaaaccaaagcctcgggactcgccagagtgggggtccatcatgatctggcacttgagaacctcgccaaaaggcttgaacaggtcctcaagctcggtctcattgacgtatcgggacacgccagtgacgaagagattggtgccctcgttctgggcgtcaacatcgtcgtcgtcattcaggggctcctttgaccgtcggtccaggtctctgtcgtctctgtcaaagtcacgtcggtcgtctcgacggtcaaggtcgtcccggtcgtcccgtcggtcgagatcgtctcggtggtctctgttttcgtcgtcccggtcatctcgacggtcgaggtcgtctcggtctcgcatgctgtggtctcggtcgtcgagctctcggtcgtcgtgggtgtgctcaacaggggcaccagcctcgtcgtcatcacgacggggagacacacttcgtctctcgtaggtctgttcaggggaagccgaacggtctgtgttagtggatgcgtgtgggtggattggcgtgatgcactggtgccgaatacagacacttgtggtggacagatgcagaccgagcccagcacaacctcatggcgaacaaaatgggtagacaaatatgggaacagctccaactggacccgttctgtgtccttgaaacaggttcggcgcaatacacctttgcagcgggcacttgtcgagtgtctcttctcttctcttctctcattctgtcgttgcggttgtgctagtattcttgttgggtggagagctcagtatctttgccaacatatataagatacggcttgcggttgctcgtgtgcgacagtgcacgccgccttgtgcgctcgcaggtatcaattactcactgtattcttcgtcggccatttttcgtgtctgaataagatgtacgaaggggtcttctgcccactgacttttacatttctgacgggggttacccggaagccacacccaactatatactatacatacacacacacacacacacactgggtgggtctccttgggagttgggtctctgggcttacggccgggtaacactgaaatttgcatgcagtgccactatctcaaagcttgaagtcagcagtttcgcgatctcgaactacacaaaatgcttcgatctctgggagctgccctcacaaacgcccgaatgggcatggctcgtctgccctggacagcctctgcgctccccaagcccacaatgagccccaccctggccgctctcaccgtgcgacacaagaccatcaaccagatccaacgagacggaggccgacctgtgccttaccgacgaaagaagtctcccgatctcgagtcgtgccctcagcgaaagggcgttgttctgcgagttctgattctcaagcccaagaagcccaactctgcccagcgaaaggccgcccgagtccgtctcagcaacggcaaggtggtgaccgcctacattcccggagagggtcacaacgcacaggagcatagtgtggtctacgtccgaggaggccgagtccaggatactcccggtgtcaagtaccatctgatccgaggagccggcgatctcggagctgtgcccaaccgagccagctcgcgatccaagtacggaaccaagaagcccgctgctccgggcgcctaatgtatatagtaatggagcatcagctagcgacacgtcgtgagctgtgtatgtgatggttttcgggatgcggtgattctgtaaataatgggatgtagaggaggttccagtgagggacttactggaagcagagtcgtaaaaaggtgctattattgagtagttgcacagttgaagtcgcttatcctgtgacaatgtcatgttccggatcattctcccgaacacttgctatctgggatcatgaacgtggttatcctggtcaggacgggaaaatggcctgctcatctacaaagtcatcgagcctggtcatattgatttaaaatacacgtaacaatcaaactcttcagagtggttaccgtaccagtacccacgccaatctatctcgataatgccttccatacaccttcactacagtcagttgttattcatatcatattcattacaatggtacatggagacataccgatgcatagctagttccgaccgttagatgaagagaagtcaatcagcagcacgctacgtcaagttactggccacctagttgggatgcttgaaggttcttccactggcggtcttcttctccttgaccacattctcctgctttgctcggttcagcaccttgaggaactcgctcactcggaatcgcattcgcgagtgcatataggccttggaacacttgatatggtagtggaagtagtctcggaagatttggatgtgcgagatacagttctctcgtcgagaggccacaagatgtcgggggaaaagcacaaaggtgacgtatcccatgttgtcggcgttagaagagggcttgacaacgtctctgatctccagcggcggctccttttgcgtgtacagcacctggggggcgttttggatggctcttcgtcgagcgtcaacgaattcctgcaggaacacctttccaaagattcggtcagtctcgtccttgaagatggtggagaagatgacggtgactcggtcgtagctcggtcgcacgtagatggactcctcgtctcggtagtggatcgccatgacctcgttatcggacttttggggggcgtacaggtccttgccctcggcagcagcctcctcggccagctggtcgaacttgtcaaaggccttttcgaatggagcagcaaacgtgtttctcttgagcagtgcaatcttgttgacaagctcgtctcgctgctcggggtccgaggggatggagccgtctgtgaggttgagcagcagcgaaacgtcgtatccaggctcgggctcggtcaggtaggggccatactcccgctccagaatcttcttggcgccgcacttgaccagatcctggaaacacttgatgtacatggacaccatgatgaccgtcttgtccttggggtccgggttggagatgtggaaggtgacattgtcgaagtccgacaccacctgatcgatgcccaatggcggggtttcggggtccagacgctcgctgagcaccgattgcagcagcaggttttggtactggagcataagcatgttggcgggtcttgtggagtgctgtgtgggagtgctgggtctcgcagtgggtgtatagtcaacgtggagatgtgtgctgtaccactgcgttaatatcgttggttagtcagaactctaatgggaggctggggacgaaccgcgcgaaaactggtggcaccaagagcagattatatacggagaaaatgacaattatattcctcgagcttgtgattgatcacgtgtcacccaaaatcttcccccagtgttattatttgccgcagttgcagactcgctagatgaccttcacaccactgtttatgcactcactcggagataagccctctgggttgcggatgtaggagttgatacttgtgcgagtactgtgcaagtacgagtaattgtagccggagtagtcaattacagcggtgaaggtaattggtgacatatgctggagaagtcgatggatagatggggtcccaattggacacggaggtgaaaccccgaccttgataatccattgttaggaacagtttacttgggagtatgcttgacattttacttgaactctatcacgagtgacgcgggaacatgtataatgggatatgtctcacatcactgatattccccctatattgaagtattccactctatcaaagtattccaccctatatcgaagtctttcacggctggagcacctttacgatgcttcactacagtatgacccgtgctgttcttcacagtctctagccagaccttcgtacattgtactcgcactgaacgcgaacaagtctctatccattcagtacagtacctcccagttcatctgtctcagagactaaccatctaaagtgttacgttcctcttagctctgattctaatcagatcatggttctgagcttggactcggaggactacgaacatgatcccagacgttttaacctgaaaacacggacatagaatgcccaattgggggaccagattcaattgttccactccgtcattgctctggtttcacaatatcactccggtttgcagtacatactagtgcagtatgtagcaagtacagttcacagttcgtacaagaccacttacagacacctccaattgcaccatggatccgatttaaatgtagtttttttgccactggctctgcaagttcattcaatagaacaatttttattcatttgactcagtatcatgacaataaccactttttttattattctaatgatgcattacagcatgttattaccataccaaaattcaacgtaaagatgcaacttcgacaccaaaattattaacttaatatcggttctactcgagtaaaaagctactaggggatacttttggtctttgagaataaatatccgatgttatttactttgtacaatgtcgataagggcgtcaaaatcaaagaaaaattcaaaatcacttttttagtctcttgaccgtattttttcacgtgattttaagattttcggccgtgtggtctagtagctatgattctcgctttgggtgtgagaggtccagggttcaaatccctgctcggccccttttttagatgccctcgaaaatcagtcctaattgtttttttatttttatttttttatctgtcatcccctccacattgcttttacgccttgcaacaatttatccagtcccttaaatcacgtgtacatactgtacttgtctgtttcaacaccctgtctggcaggacatgagatgttggacggactctcctgtggggctctacttgtaggtttagcagtcagttatagtcgatcgaagggcagattctgggagcaatacggggcagtggaacctatttagtcgaccggatggtgggattcgaaagcttttatcgagctttgaacgggcagtagaatggcatctgttgcactaatggcgaacggcgcaacgctcggaaggtcaaaaacttgtagtttccaagtacgaataccataagcaaccgaccatgcacctcaccgtcccctcttcattcaacaacagatggccagttcaaagtcgattaatgttcaaaacccccatctgtatgttccatctgttgcagatgtgtggggtaggattgaagttagtcgccgacagagttctcgttaaggcgaggggaatagtcgataaaagaggtattgagagcaaaagaggaagaaaaactagacaagtgatcatacagatcccttatcaaagccgatctgaacgggtttcccccttcctttctcctactgtaacgcttcttgggtggtacaggagaacctctcgtgagacaaagaaggtggggggcactgcagacggaagtccggaaaatgcagaccccgacaacagagtgagaggagcaaatgccaagactggttatctggatgtatttcccattgtccgacaggtttcggccgaagttgcgttgacacaagttctaattcaacctgtaggcattcgtaggtacacctcccaccgccgtacacacctgacgcggctagattgtttatttgcaactgtaactatgtagtagcaaggatacaattagcattgggtgggtccttttgattgtggagacagtttcgaacagtcctgtcccgttggttcgctgtattgaggtcacaattgcgtggttctgcgagtttacgtctagagtaagcaaagattgtccaacaatcaacttatatcccaataaaacctcaccgacacccctcctaccccacagtaccatatcattccccacaatccaacttaatgtggacttctgctgagtcttctgagtttgctgagctccttgtactcgccttgtactggtttcctatatagccatgttgggggtgtgtgtagagcagtaaaaatgaacgaatcaaccttcccaaagacctcaattgaatatctcgaggacaccaaacactccattgaacacctggaagatgacaagccgtcagttgagcatctggaagagaccaagacagacgatctttatgtccaacacagcgtcacttctggacaagtgtcagacgtctccatttcaaagaagaaagagggccatctgaaattacacagaagcatagccgttggttgccaattccaagtttttcttgcttctcatattgtttcaagggacgtgattggagtgactgtcacgggaggaattgagccttttctgaaactcaccccctctgaatacgaatggtcgcaggcagcactatacttcacctacgctgtctttgtaattcctatggctttgctgtttgctaaatcgaacccgcgcgtgtttgctggagtccaaatgttcatctggggtctctgttgcacactgttgggcatctgtgtcaattacggaggtcttacagcggacagagtgattatgggggccgtcatgagtgttgcgctacctgtaattcttcaggttacatacgagtctcatggaagattcgagggacagtttgtcattgcctgctcctgggcagtatcttggttcatggtacctctgtttgccctcatcgccattgcacttggtctgattacagacggaaagcccggttgggcgtggatgtttttcatcaccggaatctgtggctgtcttcaggctcctctggtatggagattgctaccagactacttctaccaccccagatggatcagaaaacatggtgaagacggataccagctgttcaagaaaatcaccgaaaaacactatgctggaggaaacccgatcgagcccatcgagacagtcattcagggccttggaatggctctcaaggaccccattgtctggctcaccggtgccatgggtctctttacttacaatggtatcttttcgtgctatggagagctcatgaccgtgactctgcacgtgctcaagtactcaccagctctaggtcaatgcatcgtttggcccattctggtgtggagttgcttctactgtctagttcaaaactggttctccactaagtacaagaccaactacccgttcctgctggccaactacctgtttgctatcattggatgggctctcgttctgtgcacgcccagccacaagaacttttggatcaaatatggaggagcgtggttcattatccccaacatggtcgctgccatgcctactctcgcctgctggctggggagcaacgtccaaggaagaaacagaagactcatgagctttgccgttttcaccttcatcactaactggtatggagtcattgttctgcgaacatgggtcgccaccgccgctcctctgtttgtgaaagccgcctgggtcaatatggcgtttatgattgccggcgttgtattcaccgccgccctggtggtggtgcttaagctgaagacgagtcacggggccttcgtgtatttgctgtaggtgatgagattagttgtaattgatgtgattgttgtgcgaggaatgagccgtgaaacttgacgaaacaagtagaccagtatactgtcagaagctgaagaatggtgagtgtatcactatctctatctccgagccaacaccaccacctagatattggacacccgctgaacagactggcctgttgcacgtttgaccaaaatgaagactacgagaacctgtctcccaaggagcgaatgaagctcaatcccgataatgactataaggagcctgaatacaccaagaagtgccgttaatgatgaagacgagcatcctgacaaggagtcaatatctgttcaggacgataacaaagtccctgtggctctgtgtgccagactaccacgaagtctctgaggtctgtatgccgggtgaatcctgaccgcgctgataaacccaccctgttgaacacggataaggagagaaaagtaagatcgagcgtccttccgagcaccagacaagttcgaagactttacgatggtcaacttgatgcagtgttcaggacaaagtgtcatcccacaagtggtctcagagactgcagagtggttatcggacgtcttcccagtaagtcacaagggaaacttgtacatagattaacgacctccacttgactggataggttgcacatgactggatagggcttgttccgacttgacaacaccacaggactctttggaggagtaggactgagcccacatcaggtcaacatcaggtcatcatctggccagaaaaaatccccctgctcttgtggatttatcaccacaaacgggaacaaggtctctccgatcagtagtaagtcgccaatccatttgcgagtcactgacatatttgatataaattcacttgatatttttttgaaaaattatatatattaaggtttctgattgataagataaaagacgggggtctgtgggggtcagtatcataaccactccaccatcgctgcctggttttgaaatcgctgttaaggtgcttttacgcacaagctcgtatcgctcagccacatgccatcagtacttgatatatgcagtcagacgtcacaaactgcagatctgtacatgtggactgtatcttgggttcgaactggtgatagcgattcttacggtactgtactagtattgcattcagagaggtgtatttgagaaaaaactggcttggaagtgactcctacagaaggtggaaatctcgtcggtgcacggaaagtagattcctcggcgacagttaagtagaatgatgttctacttgctctcaagcgatcaatctacttacgacaatgccgatagtgataacctcaagagcaacttatctgaacccggctacggtcttctatccgactctgtctcacacgtatcgatcgatggagttgagtgttgacccgcagctcagtgcttccactgcacatctgtctctggagtcgcgatctcaatgaatccattactgaagcctctcggcagtctggatattctattgaacgacacctgatgcaatcatgccgtggtacttgttgtgtagaacctaccgctcgccctgatcgtccgagtgttagttgagcgttggtcgaatgagcgtttgtttgactgggtgctagtagaccgaatgttagtcgaccgagtgttagtcgaccgagtgttagtcgaccgagtgttaaccctgactaacgcttgttagcccttgcactgtagcaattgacggttccagctgatctacgaaaatgccatctatcatacacagttagcatttattctcatatagtcgttaataagtcccgacgcgcggacgtctgctctaaaggtgcgtctctcccatgtcgtgtcgccacgtctatctatcgtccggaaaagtggaccgcgatcggaaccacaatcaccacaatcagaatgatgactccaatgaccagacagaccttcatcttgaagtccttgagccacatggcctttcgcacccggttggcgcctcgtcggaagccctgggccgacaccgccaggttgtctgtcttatcttgcagcgagtccagtcgttctcctctctccgccaccttgttgatgttctctcgcatgatgcccacggtatcgtcgatttgcgcctggatggcggccgttttgtggttgcccgtatggtgcgtctgcgcatggctctcgccggcgtacgggtcgtacggcatggaggacgacattgttgttggtgtagctagcggcaaatcgtatacctggtggtgcggttcaaacacatggttggcggggtcgcggttagggtagatggtgagaaccttgacccatgtgtttggttattttggcccggaggtatttttagaccgagcggagcgcgttgatacgagttggggagcgagctattttgggcccttttttcgttcgtttttgtttacagaaaatccgcttgtttttggcccgtcaattggacaacagggtccgtctgagtgcgccacgcgtggctgggtagagttttggaagaaaaataaaaataaaaataaaaaatagaaatataaaaaagtcatagaactaaaatctggaaaaataaaaaaattggtgagaacaaaacagcacagtgcagtaaggtaagtagagaaaggcgttattgttggaaaaaggaaacctttagctggttatttacttaattgttggggagttactgggtacgtacagtatgtacagtacagtacgtatgtgtactggtgtgtaatataatgacaaccaggtggcggaattgatccactgatcggggctttttgagaagcccatgattctatggtaaaaatattctgtgtttttctgttgtacaattgcaggcaccatcttctcgtgctcatatctgaaaacttcaaagaaccgtcttggcacataaatgacaattattcacccaattcgactcactctgagcattttatgactgtaaaaatgtccacgatatgtattttgacgggaatgtcacctttttcgatctcctgatatactcatattctcttgggtgtctccgaagacggacaaccggctcacggagtcaatcttaagtaattaccaactagaattataacaaattgtagtggaatacgtaacaacaacagagccagactagagggatccaggagattttgaggagttgcaacatctaatgtttacatcagaacaaggtactattagtacaagtacactacattattgtccctcttggcgagtatcactctctagagtcactctttccagcataacactactccgcggagagtatttgacaccattgtctgacctgaggagattataaaagaggaaatgctccggtaaatgtccaggcccaaaaaatcgttgcaaaggacgcctggaacatatctctcagtgcccagaacatccctaaaatgaacgttggaacttgctcgtccgcagatcatctcaattccgtagaggtcatgaggtcttagggaccaaatcgcctccccagatccactcatctccttctttttcccattcttggttctggctctcgtgacgtcatcagtgcacaagaaagttggtgtctggtgaatgaaggaggactaattgtcagtattgtacattactgttggtgatgcaagaggttgcgaatatggagaataaggacaaggatcttgctaccacatagatgatatgacaacatcagtgcttgtatttactgttttttggccggactcgtcgaagagccgagaaaactcgattacttttctcccatacttctctcccataccgattacgtctccccaaccaacactaatacgcaatgtctggcaaatcccggaataactattcgtactggtagctttctccattccgttccatctcatttcatttcacttgccggtctctctttctgtccaacctaatccaatcaggaatgtcgggttcgtccgctcgttcatatatgtatgtattcgacacgtgtggcttgactgcggctcccgtgctttctgccgtgccatctcgcatcgtctacacgacgcagaagtcgcggaatcggtgcgacttcgaccggtgggcgtttgttgcaactttttacgatttcaactgcctataatatcgcccggattcagtctcaacggtcgtcaagtcgccatgacctccccccgctaccattggcgaatccaatcaagcttcgcgccgtccaaacttgtctttctgaaaaacagtttgaaacagaagcctgtcttatctagatagcgacgcacgcaaccacgcaaccaccagacgtgtgtcccagcccgggccaagacccgataacgcgcgataagcggctaagtttgcttgttcgagtcttggcaggcttggcaatgcccctcagacgaggttttctcgaccacaataccctccaacgcccactccctcctgcctcttctgatccactacacgcccgaccatgcccccccccaaagctaacatggcctttagtgttagtgtttgagcgactgtatataagtggaatcggaaatttcgacgagtaaatcactcaccagtcgtcggcatagtgtcgtcgcttttccctcctgtccttatcgccatcgctcccctcaccatctccttttccgctgctccaaacccaccatgaacgacccagaggctaaaccccccgacaccctggacaaccaggtcctggccgacattggatacaagcccgaactgaagcgcaacttttccaagctgcaaatgtttggaatcgccttctccatcatgggcttgcttccctccatcgccacaactctctcctacacactcccagcagggccctacggaatggtgtggggttggtttgtgtgtgcgttttgcgtcatgagtgtggggctcaccatgtccgagctgggatcggcactacctacttcgggcggtctgtactggtggaccttttattttgcgcccgacaagctgaagcgcccgttgtcgtttctggttggctactccaacaccctgggcctgactggaggagtcatgtccattgactatggatttgcacagatcttcaccagtgtgatcattgtggcaacagatggacgctggaacccgtccaaatacaccgtctatggcatctttgccgcctgtgtggtgtctcacgggtgcgtgggctctctgggaacacaccatatggccaagttccagaccatgtgcattttcattaactttgccgtgattctggtggtcatgattgctctgccaatcggcgccagaaacagactgaacactggagagtacatgttctcccacattgacaacctgaccgacggctggcccgacggctgggtgttttttctgacatggctgtcacccatctggacgattggagcgttcgattcgtgcgtgcacatggccgaggaggccgcagacgccaccagagctgttccgttcggaatcatctcgtcaatcggtgcctgctgggtcctgggcttctgtctcaacattgtgtttgcagccgtcatgccccatgatattgccccgctcttgaacaccaagtttcaacagccgatggcccagctggtttacgactgtttgggaaaaaactggacgattggaattatgtgcattttcttctgtctacagtggaccatgggcctttcgaacgtgattggagcgtcgcgacagtcctgggccttttcgagagatggagctctgcccttctccacattcctcaaggtggtcaacaccaaatactcaaatcccattagatgcgtctggggaaacgcccttttggctctggctctgggctccatctgtatgatcgatgctactgctgccgccgccatcttctccctgtcggctggaggcaactatctggcgtggttcatcccactgactctgaagctggtgtttggacaaaacaagctgactccgggcccgttctatctaggcaaacgactctccattgctattggaaccttcgcgtccacctatctgttctttgcaatcatcctgctgcagttccccggcaccacagcccacccagacaagctgtccatgaactacacatgcgtcattctggccggcgtctggggaggctgtctgacatactactttctgtttgctcacagatggtacacgggtcccaaaaccaccgtcgatgtggtcgatggagtgggcgagtcgtcgtgcgagtcgattgagctggtggatgagtccgagggcgaaaagaagagggtggtcaacgactactcgacgagtcattccacgagtcagaccacgttagagtgatatagatattagacgacataaaacaaaagatggaaactagaagcaaaaaatagaagcaaaaaatggcgacatccgcaggattcgaacctacgcggggaaaccccaagagatttctaatctctcgccttaaccgctcggccaggatgccaattttatcgtgacgtaaaaatcgctctgaattgttaatatctatgttgtgattacacaatcaaacgaatttagaatgaaaaaaagaatccaggttaaaactagaatgaaataaaataaatgaaatgaaaaaccgaccaaaaaccgacgttacaaatagaatgactacgagatctaattgaaaactatctcagatattgcaatgccttcatggagaacatacccagttcgtcatggcgttttctttggtcaagcgaactgtggaaatgacgaactgggattgtgaaggggaagacactgtgatttgtgatttttttcttcaaaaaaccgaatcaatgcacgtatttcaccatattccaccattccgcccgagttgtatgactgctccttgtttcttcaggctatctttcgaagctgtccaactcatcctctcatcattacaaccagatgaccgatcataagagtaaagcgtttcaaaagccgtaataggactctctcagaatctaacagttacgatcacctatcacacggttgtcaaccccctgtgaggctttgattcaccacctggtttcaccacctagttcacaaccatgggtctcctactcatactactggtgcagcacagctctccactatttctgcaattgggtctgcatattctaagaacaaaaaggtgaagggcgggtctctactccttttgtcgagatcccaattcaagctcaatagtcaccatttatggcactcatactacaaactgtgctatcactgagctgagtacaagcaagagcacgagagtacggttcaactgaagtctgttgtacttcagctatggttaatctgctctgataatcgctctctcatggcatgtcctctttcaattaccgaaaatgtcgacagatatacaagtacagtacattttcaaattggagatcctaggttccacgacccagttacattgttgtatatcatatcattagatgtccgacgaattagacaatggtaatgacctgaaaaaaattgaactgaactggacttggtcaaactgcttcatctcgttggcctgtcgctcggctatgctgtcggccaacagtcaccttctgccaacaacagtttcacagtgtcaaatgctggcttaacgtgtttctgtcgcttccgcagcttctactcaggtgacagggagataaccaacagtccatgcggcttagatcaatacggttgcattgtcgccgcaggctgaagttcggtcggtggttgcaacacccggaagatcaaaaatgtctccattcctcccggttgcgaatgacgtgaaactcccggtggctcctgtccactgcacacactctcccgtcctggcagtaattggttttgccggctcgaagatacagccatcttccacgagcctcgaatatgcccttcttgacggcgatttcgaccctgccgttggacatgagcgtaacactggtgatgtttgagtagtcgctgatcccttccagcttgacgggagtcggtggatttcgcaaaacgggacattcgagctcggaagagggcgagttaaacgaaatgatacctgagtcttcgttcagaagaggagacctttcatgcgagctcttgtgactgacattgttgctgtatttgaactcactgagacagttgcgacatcgacagaggggtttcggcctggggacaatgttgagctccaggtgctcgacgtgtgcgttagaataaacccgtccatcgctgcagtatctgatgaacacgggggcgtttctgaacccttttccgagccgtttttcagactcgtggggcaccatcagcctggcgttgtggaaggaaaagtgcgggatcttccccagcagatttccgcactcagtgaaacccgtgagtccaaacgaatcgcctggtttgctcttccatctgatctggacgccaatgagcatttcgcaagtgtgccagttggtgaagactatggttttcgaatgtacgacgacttgcaatccttccccagacccgcaggacacgtccctctatttatcatcttcgacgatgatccgatagactcgagttgaaggttcacacggcactcacgccacacatgtcttatcaaagttgccaggtgataccaaatctgctgtggcggagttgatagaggttcagatattggttctctgatgttgatgaccaggtgtgccaatagaggccgtggttattcctacagctagacaatgtacctgctaccactactcaacaccattctacagttacaataccgcattttcgcaccacaatccagatctcaactaaggtgtatttgccacctgttgtttattttcaaaactaaaaccaatcatgaacggacttactaacacattcaactattgtgtagcccacgtattttgtacgtttttgatggggtaaaaaatactaatgttataaaatattttgaataaaaaacaatcaaaagtcaaatttaaggtttatagtattcggttgtatattaaactgtaaataaaatattcagacatgtatctaaacaaagggagaacggtggaatggagcccaaagaagtatcaaagagatgccgacgtctatatgcgttaatagcactaataaatgatcacgtctcggtttttatctctaaagaccgtcaattgccagtcagcgtgccgcgaccactgtcgaggtaggtgctccacctaccagacggctatggaagctgttcaaacagacaccaattgcaatctgtcttttcacttttcacctgctgatccttccacttatcgaggggaccgtcgtgttacgacttcccgtctgatcgcccacagtcaagcttcagagagcccagtaagtattgcagggataagtatttgtagggaaacgagggcgctgtaatcttctacagttggaacatcactatagctccctcttttttattctggctgcgtctacattgctcgatccctgaaggagttgggttgtgtactgtagctatagctgtaacccggactctgctcgggatgtcctcagtatcgatagtaacgggcttcttggtaacactaccattgctgaaagttgactgatgagattgtgattcatggaagcaacccgtcagggagaccttgttgccatggtcctgtctgaaacacattcgattggtatatctgacgtttgaccaatgttcatcaacacctgtcagtcattttggtggagactcccttgcccctaccaattgagtgctaaacctggtatgagtggaactaccatcaggtgcgaggtagtcgagaagacaatagctaccatcatcttcccgaattggtgtagattttgaagtggttcttaccttctacatgaatgggctccatacctttgaagacgccgaggcggttatatcaatggccacattccaaggactgaactcatagtatcctcatgtcttgatctggtattggagggctggctcagagacttgaggtgatgttgaagatggttgtcatttggcggttagttgagttggatcgagaagtgcagggaacagaacatcgagaaagtaaagtagagcatgatgttgatatctgttgacaagtgcgtccatgtgcgaaagtcttgctgggggctgtacccgagctgttgggtagagtgggagacagtaagcacacagtagctataccctctcgtatagcaccactttttctgtgttactatctgtagcaaataaagcaaacatctggaaattccaaagtccaatttccatacgttcacttttcatgaatccacttccttttggggctgtgtgtcgacttttcaggtgcgacgtcatattgaggctgataggaactacaagaagacgcccgatccagcttgcaagacaattggggctgaacgagatctcgagatcccgacagcacttctcttcttcttgccaacacctctcccacatgaccactatgaaagcgaaacgaaatctactggaaggagctatcacaaagatgacactagaggagtacgatgagtacgtgaacgacaacctatgtactcagtgttacctccaggactttgggcggttcgatttcgtcttcaacggattgccagaaaccagcacgtgtcaacaggaggtgtttctctattattatgaccaaaagttgaagcagagacacgccagcaacaaggccgtgttttgggctccctggacaaccactttggattcggtttcggtggccattgacattaaccagtttcttatctacaacagaaccactggttcaaagaaccacctcatttcctacgatgggtgggtaacgttcaaaagcatctccctggacgccaacatctggatattgctagcttcccaaagctccatattcgatgtcccaacttgcacaagtgtccagaggaaaggcttggcttgtttgagacagtctggcaacggcgatttctgcatcaaaagtgaggacggacataccatcaacgtcctgaaagccgtgatggaagccaattggcccttcttcaaggcgatggtggaatccggcatgagagagatcaaaaaaaaccaactagagctgcctctacctcatagtacagtggagatgatggtgaggtacctttacggtcaggagttagagctacaggtgaaagaagcaactaggctcgttgaagctgctcagatgtacttattgcctgagctgctggagatatccctcaagttcatcgaatccgaagacacggacatcggtcagacgattcaggtttggaaaatgggtaagaagactggcaacttgcgcatggttttctgggctatggtaaggattaaagagctgaaggtcgacaccgacgttctttacgatctggacaaagaagatctgatttcgttatttcaaatgatgacccttggcaccgatcctaagaaatgattgatcttcggccctgaaaatgatcatcttcttgccatagtgaacaatcagttaagcgttgtatcttcaaatgggcgttttatcaatagaaacacactatacaggttctttcaagggcacagtacaaaccaatttccattacaactcccaataaggggtgcttcagatatgggactggtgtatgtctgaaatcaatcctttccagtcgttttgtgattttataccgtttttgcagcgttgtttttaatttgtattctaatgatcaattaccgccatatcaatcgattcatgtcttatccagactcgaggttggtttagtttgttctcgtatggatcgtcgaaggtgtaattcgtgtgaaaacaacttcggcagtcattccgcgccgtacatccgcttcatagccatgaccacaatgtcgcgacgatatgctgcagaaactcagatgaacaagcgagttaagtctcgctggaccacggggtcagtacccactaggccagtttttcgcatagctcgctcgaactgccacaaagaatgggggagctgtctaatgtagttcagcgggccgtccttggcttccagcaagatctagtccgccatttttgatggaaaggggacaccaatcttttggcagatggccatggacgctggacaattgacaaaaagatgcacgtgaaggtagttcttctgtctgaagagtagacaagaactatatcctggtctctgtactggacagatattgatttagggtaccaccaggtgaaggaaggggaggcggctcagccgcatcatgtgtggcgtagcagcgctcctatcgtcacgtctttcgtgcttgctcagggactgatttgtcttgagccagtgtagatggtttggatcaagctccgatcgcagtgtctccaaccagtgcttgttcttcgtgactttgaaacgaacgcgtcagccgtcctttgccaccttgacagggactttgcgatttgcgatatgcaacttgctctcgagacatggatacgatcgggttttcacgacgctggcgttctaacagttcaactgtcttcctcttctttgaccactccgccctggggcgcaagtcaaccggaggctcagccagtacagcaataggagacagccttgcaagtcttcgtaggcaccggtccgtggattcagataggaagtggcgccagtgccagtttcccgtctcgaactaccgaatcttgatcattctcgtagcagggtgggagtcgtgcccgtagcccaagtctactgtctcgctggcaaagaacatagcgtttgtcttgcagcagtatcatccctgaagaaacgagccgctcgcgtggcacggagactctttgcttgctcaacaatgttcaaaaggccaatgccttccgctctgagaggcaggtagatgagctcgtcgttgaagaagcgcttgtcaaagtttcgaggcgttcttggcgagaatcctgacaagatcgggatcactccaggtaagacgcctcggatgttgctggtcgacgctgcctttgcttgaactgccttgatgtagttgatgatcctaggcgggaaacccacatgttccaaaaccatgatgatccactcctggctgatcgagtcgtaagccttcttgaagaagaacataccgagcatccaggactccctttagccatagacactgtattagtgatacatcgcatcaaggttggtggccatctgcctaccaggaacgaaaccggtctgggctgggtggaccaggaagttcagggttttctgcaaacaacggttcacatgtgagtgaagatcttcagcttggtgttgatcaatgggattgggctgtaactggcgacgtcggtgggatcaccatccttcgggtgagtcaagctgtcgttggaaatcactctccctcatctgattaagaaccgactcaggaacctctttcagaaactcttcaaagccctcagggttgcctttgtgcttgtagatgtctgtgaaggcagctgagtgatccggccaatagagggtgtgtcggagaacaaagtgccatcgggtcctcgcagggacatgatgtttgcgctcttaccacaggacttgactcttgctttcagaggggtgaaactgagattggtgagtacgtggtcgtcatagggcgaccgagaagtggtgcctcattctgaatctcctgaagacgttcagggttgtctctgcatttgacccgaagacagatagctctctatttagagtccaactgaatttgcgattcgatagtctccagtattgagataaaccgcagttccgtgggtagaggttttcttagggcaaaagcgttgtcaactacctctgcgagccgaggaaaataatctgggaaatagatatgttcacgttctctccatgtgcctttctcgactagctccggctctgtgggggactgaaacttgaaggtgctgtacactgggtgatgggaggacctgttccggcagtaggtccaaacccagctggggggggttaggaaccccgtcttggtcgggggggggggggggtccagcccgggaggccccgccatcgagcctcatgtcgtcgtcgtcgtcggtgagagaatcggtctggaagtcggctggaacagtggtggaactatatttccttggatccccggaaatcggatggccgtccatagcatccttgtggatggacgatttggctacagcctgatcgttgatggtggcaccattggcgtaagtgatgacgtggtcaccattggggatagcaacggagaagaagaggacattgttgaaagcggtgttgattgaaagaggtgaattgggggagtgaattcgtctgatcaagtatctatttactatagcaaatcacgagagaatcggatttgaaatttgaccaaagtgaagagagttgtttttgttgtttttttctactgtgcaacgtcgctttatactgtgtactattctcaacccctgctcagccgtcgggccaatcgctggatcttttcgtcatgctcgcccatggccttcttgaagccctcctgctgctgttgcttctccttggcctgctcctcactagtaggaggcaggcgctcgttgctcagatccgcgcttcgagcctcctcaaacgaagtgatagcatctcgaataccctggccaccgagcataagggttccttgaggaagcttgcctccagacacagccttaagctcggaaacagactcggactcttgtcgcagaacgttgaatagacgcgacatttgcccaatggccagaatcttgtttctgagagcccttcgctggtcaaacgagatggtactgggagcatcagagtcgccggtggcgacagaagcagcgggctcgggttcagtagcctcactgatcccgctaacgttgtcgtcatcttcaagctcctcctttgtgcaaatgttgagcatggtgatgagcattccggtgatcttctcacccacaaagggcaaggaccaggtgaacacattcatgaagttgcgcagccagtagggatgaggagatgagttgaactgccgaatgttcatgatgttgttctcatacttgagaaccgcagccttgttgttgtatgcatccagatagttgggtgccgagaagatggtcattaccgaggggaaaccagtgctcttggtttttctgtacattctgtagccggcatcttgggcctcgtgagctcgaatgatggacagcagtccgttggcctccaggaaggcacaggcggcgtgataggagtagaagaaggagcagcctcgcacggagttgtggacaaagtgtgcgttgctcttttcggctccaaagtcctcgcagggatcggcccacagcaaatcacacatgatgccatgggtggggggctctcggaaccggtctattcgccgcagatcgtccagggtatgcaattcaggagacagacctccgtggacacacagaaactgtctgtttacaatggcggccagaggcagggtgcagaaggaggccagacacgcctcgtacagatcgaccccgtacttgtggacacattcccgcttgaatgtgaagtattcggtcagatgacggcactcgtggttgcctcgcagcaggtagatggagtccgggtagtggattttcagcgaccacaggtagagcacgcactcgacggaaaagtagcctcgatccacgtagtcgcccaggaacaggtactgtgtactgggtccgggggttcctccaacctcaaacaacttgagcagatcgtaaaactggccatgcacgtctccacagatggtgatgggggcgtccatctccagcagggttggttcttgctctagaatacgcgatccggcctctacgatgcgaatcgcctgctcgttggacagtcggccttctcggtaaatgtggtccttaagaaactccaagttgggtttcccggtggctcggtcgaacacgtcgtcgtcggacggcttgctagtggcgggtgcaggcaccgacttgatgggtctgtcgatcgtcgacaccaccgatccgtcctccatggtgtgctgggtgaagtcgatttttggcagtggcttgcggttctggaacgccttgaccgcgttggagagctgtgcgttgtccatcgtgtgtgttgatggaaagtggtggtcttattagttgtgtgtctgtcatgtggtgaagatgagtgcagtatcgtgcctgttgtgcgtcaggggcaggctgcagatcaatgagacaggttcagagcgcagttgtgtcgcttcgaatggtcgaagagcgggaggaacagcgagctggcaaccgagagatggtgtattttctgtacgtcgtcgagttgtgggcatttatttgcactcaactagcccaaccactggtccagcaaacatctgagactgcgtggccaagttggttaaggcgtacgactgttagaagcatcgggtttctgtaatcgtaagatcgagagttcgaccctctccgcggtcgtcttttttgctctccagagataccacatatatgttggactccttgcaccactttatatttgcacatttctgcgcccgcctcgagtctttgtggttgattttttttgttaagcataccagctccgtcgtctggaagatcataattcccaactaaaaggttgaagtatagttgacaataaacagccacatcgtaactaatacagtagtataaagtataaaaacatgcaaaacaaagccgtccaaattaattcaattaccgattgaagacaccactatgtacagtatactgtcttgtacgttctggaggtacaatccaaaatttggcaaaaaacaactgcccgatactggaatcgaaccagtgacctttgcatctcaaactgaaatacaagtgcaacgctctacccctaagctaaacgggccctgattttctgatcttgtaaaaagtagccaccatagtgtgaaaaaaaaagttttttttattggaataaaaaaaattcaaaagccatgattcactaccacgagaccacgacaatgacatcaactagacgaagcgtcgacaaacaaactgacagcgcctcgcagcgcacaccgcaaagattcagaagtgtatgatttattgaacgccaataacccggcttactaggtatatagctgtaatgaatcattagaataaaaaattggaataaaaaaaacatcgtctaaaaaacgccgctgttaccacgtgacggtacggaaaatatctcagactagaagataaatgtttttagtggcctgatattcccttggaaccctcaattcgatatcgaatgctgtggagtcatctaggcatgggaggtggtggtggtggagtgatgggctggtaaccaaacatcacaatggatgggaaagaatcattagaactaaaaaaaatgttcaattggaaggtcaattggtttctgactggatatccgcctgaatctataccagttccgccgtcattgacaagatgaacatgttatgaagaaaaaaacactgaggtataggagcagagcatacaagtatgtgaactgtacatactgtacgagagtccgtctgtcggattcaattacaagtaccgggtttcatatgggtattttcttggctcgatgtcgcatcagatgacttgttttatgtagcaaacttgcacttgtgcaacataactacactacacatattgccatgattaccacctctccaattgacacatgtgggatcccaccacaacaagacggtgcgaaaaacgtcgacagccggtgagtgagactgtcgacctttcaattgaacggttcgctatctttggaccaaaaattggatggagttgagtagttgaagatctcaaaaagactgagtctcccgtcagacctgacaaccccactattaaacagccagtgtcgaaataccgactggataaaccgatgcagagttcgatttcacgtggattcacgtgaattgcgccacctaaatacatttttcagcatacaaatcgccataaaatctgtgaaaaacaccggcaacctggccgagcggtctaaggcgccaggttaaggtcacaccttgacgcaatatcctggtctcttcggaggcgagagttcgaatctctcggttgtcacgtcttccaattgccaaggcagttggatatctttttttgttatgatcatgcaagaatgattagtcattagctcgagcatctcgccccgtctgctcgtcctctccacactatcccgcggtcacatgaccccaacactcacatagctggactatagtggctcaaggtcaatcgcacctatatcctgatggtacggcttatcgtcagccgaggccctaccagtagttggtctcaatatcagcaacatcgactcatacaaggctttcttaaagctactaacaatgtaaatgtgccctggtattactagttcagtacatactgtacagtacctaccagaactatatgttcaatatttcatcgttaacaaacacttctctacctatttaaatctcaagacagtcgaaccgctgcgtccagtccgatatagttgtgccaagccaaacttgcatgttggaagcaaatcctccggtcttcaggatccagaggggcgatgccatcgtgacgacgttcggtttcagccccgtgtccaaattgcagggcatggaaatcagctccaacatggaagtcaattccgtcgttgtctggctggcaaacaattcgtttctgggtaatcagagcctgacaatttcgccaagacgacacgttcatgacaccggctttggtgccaaagtattttgtcatcgtcacatttagcacagttcggactcggtccaaagtccacatatcatcaaaaatcaccgcgtcgcattcctgctcgtgagtatccgaagtttcaggcgggtcgtcgtcgtcgtcgtcgagctcgtcgagaacgcgctgccgatactgcgattggaacagatacctgctttgaagaagtgctcgttccccgacagggcgacttctgttgtacagcagctggttcatgcacatgataaacggatgaatcacggcaatatagaccaacaaggaacgagctaccttttgaggcaggaatcgatgcacagtctttaggacgccagccccctgcttcttgtaccgatacgccaacgctcctcctcccaagccgaattcaacgtttctcttttcccacgtcgagttcatcaacctgagcgtcaaaatctccgagcatcttgccggcgagcctcccgtcagttgcagagcaaccagcagcagctccttgaatctgacaacctcgacgaagaagtctctttcgcattgaactctgctgagacgccctccgttgtagattcgcttcgaccaaaatcggtccatcataacgatggggtctcctcctgcccaatcccacagccttttcttgtcagcaggcgattcgcccacccttgttccggtgcattcaacttccatatagtcgagaaacatgcgagggtccagagctgaaacattcctgcccaccagtgcaacagcctgcgactctaggtcgtcaactagacgcatgataccagacttgatgtgcgactcactagtggccgcagctccaatcgaaatattcccgtcctctgacaactgcacgttgcccgtcgacgtctcggagatggctctgccgtatgcccacagcctcaaaatctttccggccggtgtatggccctccgagctgcgcttggttcgaatgaacggttgacactcgcgctcaaaaaatcgtcccattgtcagattcctccctccatggttcacgctgagcatcaattgggatgcacagatgctaaagtacacaagcatcagtttaatcatcagcatgatatgcgcaatgatctgcatcgcttgctttagcggcctgaacataccgttcgtctcatcccagttcagagcagcaagacctgcctccaacggctggtatgcggcgttagcacaaccgctataggaatagcagacgacactgtgccaaaaccctaacactgtccaagtcttgggatccttcttcatgatatcgtatgctgcacgctgattggcggtaaactggaagatctttggccgcgacactagaacgcaaaacagcttgcgaaaagtggcgagatacttttccttgaagacaggcacaaagacgggctcctccgtgaagttctcagcctgggctcgcacgcgccaaagatcattctgccaaagactaacagtagcaggtgattcacccatttgtatcacctcatccatcaatgtgtcatgtgctgtcagaagcgatggaggtatattgtcttccttccacatgtcagcctgtccggcgagagcatcggcagagcgtgaccacccggtacgttctatccacattgcgtcggcacgttcgagatcctcgaaatgcgtcctagttgcagtctcatttggaatgggagaatagtcggactttttcacaaacacaaagtccagatcctcgtaacgcatctgattatttgcgaggggggtcatcacaaaatttcccttcctcaatgcggcgaatatctgagaagcatccatgagtcgactatcggtggggctaggtgaaggcgctgtgtgtgtgtggtggttgttggacgacaagggtgggtcttcaggcgaatagtcagggctcttaggcaaggagacgcgtaaagtaaattaagacgtgaaccttgaacacgtacagtatgcaggagagaggaggcttcgtcaggaagagagctggataacgggccacttgaaatcttcgaataatcatgtgaccgacttttaatctacacgaatatgatcacgtgacttttctcatgaatattatgctgggaatttcgtgatagaggtatcataagcagggtcccattgagtaatcacttgaaagttcgacacaccaaatggagatatgatttagttggctgccaatggtgtcttttattgagaatagagttcggaagtagtattttcaccaactttccaggttactcaggaagacttaaatggaatttagtcactagaggaatcctgcagtcggtggtcaggttggcctctcttcgttccaaggatctccataaaggagttacctgactaatcagatgtgtgttgcctctgatcgtagtaatcgagctcactgatgagaactagctctaacaatcggaacttgttcaggagtagcgttgacaaggttactttcatttaatacatataaactccattcaatgtctttcaggtactgtactccattcaatatctttcaggtgacttttcaaggtgacttttcatgaagaacctgtctctcaaacaatgactaatcaatcaatcaattaatttgatttaatttaatttaatgttatataatattattttgaggttgttacaacaggaattcaattacatgggaagtccagcggggtcgctcgcgtaaatgttatattttataacggagaacgtcaggcaattgtcacggactgtgtttatgggaccagaagtcgggttttggcctgaagctccagttacagtatacgcgtgggatgaacctatctatctaacaaagggtttgtgtagttccatgtgtgaaacagcgtaactgacctccagtacgtccctcgtaggtctgccctgaacggaagacaaactgcagaagtccaatgctctcttgctatacttaaagtcaagttgtgctaccgaaaattgtagtcacaggattgctattaggacgtgcttctgtagctctcacatggtttacaagacactgtggtgtacagtatgtactacgataccgcattgatacagcggatagtgttatgtatgcattgataatcgataaaggtatgtaatttaagagaaactggaatggtagcggcggttcgtgagacaaaggtaggatgtatgttaggcaatgagtgaaggttgaagacgattgaggcgtcaggttgtagttacaagtacagtatgtactgtagtgatccccttaaatctttgcagctccaatggtgaacttgatgggcttgtcgcaggcgtagcctccgttgaagacataaacctcctggccgccgtgaagagggtcgtccttggacgtgcaggagtagaactgggtggtgccgtaggacgagaaagacacgacggagccgtcgccgttgaagccccagcctccgctgttgccctcaagaggcggagcggggtggtccagaacctcgagcttgccggtctcgacgttggcgaacagctgacggggctcctggccttcggacaggacgttaaccatggcgtttccaaccgagtcggcatagaagtaggagaagccctgggtgagaccgtagaccacgttgttgcctcggatctggagaggcttcattccgatgacaccagggccggggaacatgctgagagcatacttaggggtatcagagtcgtttgggggttcttcgcagacaatgggggcggccagagcggcggtggcaatagtgaggagagtgaaggggttgatcattgttgtgatgtggtcgttgtgtttgtggtgacgtggtagtacactacgcacggaaacactgccttatatgcttttcggattcgattgtataccgcatctctgtgtcatctgatgaacgggagtcaagagaggtggagatatctgagacaagagccgcacgtatttgcacaaggagcatttgctcatgatgttcaaagttgtactaaatgtagcacctgcttgatcgatgcaggtgtgatggcattagtgaaggggcgtaaaagtggcgatgacagcggaataacagtgtagcaaaacctttactgatggcttggctgactatttgtagtcttggtagttttttaccatgttttccgattgaattacacacttgattcgcctctttgatttcacagcctgctttttccaagtcagtaaagtttaagtataaatagaccgcagatagtgtagaatgacatcacgccaagaggagtcattgggcgctgaggggatagcggtcctcagggacaagagaaaacagcagacgcaaaaaaaagcaaaagaaaagacagcagacgaaaagacagcaagagaaaagatcacaagacaaaaacattaagagaggctatgtaatacctatctgctgaccccgttgtccttaaatggtgttttgtcttctgttaacagtcaccatcactgatagagttacatgtccaatagatacataattactgctcctaccaagatgatagttataccaaacaaaacagaatgattagcgctatccatccgtatgattttttctccaaaaataaccaccaatctaccctcaaacaccagtattatcacccaaactccccaacaaattggcttccaattactgcacataccccaccaaaatatccaaagatattatacgcacattcagaggggtccaacatgtcaactcaggacgtaatgttgactaatgtatgagtccagtatcttacaactatcttattactcatcagataggcagctcaactacgtcacgtgactgtcaaagtacagtattacgtaattgaatacatcaaaaaaacctcggcaattctagctctttggatgccgccgtatggctatcgtaccaaccgatgtcaacatcgcgactgtttgattacatccgaaaagagtcacatgatataataatcagcgtggtcaactatttttcgcggttattattcaacaatacgctgtccttctggtcgcattgctttgctgccatgtacgatacttgtgccaccgtccaatatttggtgatagccagatctgaaaacacccaatagtcatattaaaataaaatagatgtaaatagctatagcaaatggtaggtactctgctttagtacgtacggttcccctgaatatcatgctctcatcttgcttacgctctccagtagatggtcatatacggttagactggcaaatccataacatcattatccagccctccccagttgtccgaatacagctcagcgtacttgatcttgtccacgcaaaactcctgcagcagcttggatatctgcaactgcgtcttctggaacaggccaatctcctccgtaatgcactccctgatcagccacgttcggttcttgtgggccgcaatcatctcggtgtccatcttgatggcgcggtccagcttctcaatctccgacatgagcgcctttctctgccgggccagagtcacacggccctggttctgctggatccgcttctccagcagcgggatgttgttgcctccgtacttttccaaccggtcaaacagttcccgcatcgagcccagcgcctcccggtactttttggcctcttcaagcactcccacctgcgaacctcgtgcctcgtcctgctgaagctggcagtcggtttcaatgcgtgccgaagcccgactgagaccccgagtgatctgctggacgcacccgtcatcggcgacagagtagagcacgcgggcggagggaggaagagctgcgccaaggttgtatgcgattttggcgctgtcaacagcctgggcctcttgtcgtttagccactcggtccagaagaacacacagctgaaccacggagtcgtgcgatctgtccagctcaacaatgagaccggcccatagagcagtcgcctgctgctcatcccactgttgcacaaactttggatcaatcgttcgtccgttgaactcttctcgggcggtgttgaacacactctttttccagccgctgatatcgtttcgcagggtgacaaaagttcgcactgcctcatcctggcccagcacggggtgccgaagaacttggttaatgaaccgagtcagacctcgtcgtcgacgttccaaaaagtagttgtcggaggacagataatgaccgttgacagccagtcgcttgggcggcaaaagtggcacctgtcgaaaacagtacttcttcagaagatagtcttgcagccaggaaaagtccgagtaccgtcggatgaccgtgatgcggtctgttcccgacactgaagagattgagtagttgacgtgacggaacaaaaacatgccctcgcgttcgggcacaatagccagtgtcactgagtcggccttgttgggtgcgaaatcgggtcgtggaggggcagtccatactccagactcggactcgggaaccagggcctgggggttgagaggaggtggggttgtagagcgggacagctgcgattgcgacagctgtgactgttgtagagcctcctgttcctccgggttccagtccagagcactgtggcccctgctgtgtccgttgttgtggatgatgctctcacttctgctgctctggatgctatggtcgtcgagatcatctccaaacagcggcgtctgtgatctaccggttgtcgaggcgctaaagttgatgctagaccgctcgccctcctcggaaaagtccattggcgtcagagtgtccacgttgacgagctgcgaagggtcgtcgaacggcaggccatcctgcgccacattggccagcaacagggctgctcgccacgactcgcgagtgaaggacgatgtgagaatgcctccgctgccgtcgccgccctccagaatcgatcctgccagcgtcgccagccggtccttgtcttcgcccgaaacgttgatggtctccaaaagccgcttgtagcaaactgcgggaatccggccgtctatgggatggaacatgtcgaaaatgtggtcgtagcgcgagccatagcccgttcgctccacggctgtagtggccgccgaaaacagagacatggtggttgttgtggcggtggtggtggtgttattgtggcggcttgaacctgggtcctgtttaccacttctcttagcgtcaccgagtgcacccctaatcaactctattcgatagagttcgttatcctcatccgtcccaacatgtaattttgacctgtcgatagaactaaaacagaataaaaaaagaacaaaaaagaattcgacccaccgaggggggggggaaacgctctagcgagatctaagcgataataatatcgaggccacgaatagcctgattggatatacactgggtgctgttttgtaactggccctttggttccctccagagtattggttctgcgcactgtgactacaatcagcactctctacaatacacatcgtcgttgctgactgctgaagtagtaattgcgtacactgtcgacttcactcgcctgattttgacatctggatcaaacaagtgaattccactgctctggaagactctatctgataccactatatacatccctttgctccagcagccctacactccttatcattgccactgtcattttatagccgctaaagtcacccttacaaaggagctatgacagcggggtcgaaaaatgtagagtatctggcatctgggtgatgatcactgtcggtaatcgatggaatggctttacgacgtgaatagtccgctctttctggccatctttgcccagagacacgttgattgtaaaaactatttttacctgagaaatataagtaactttgttgaatttaattgatggatctaagctgttattctaatttctaactatattactcacgacaactcataccccgaaactcggcccatcgatcgcgccgtgagaatgactttacactagtgaatggatcgcgaatgagcaatttcgcttcagtccttgagtctagagcttcttggccattttttttattctagggaaatacatttcagctacttgaagcctatatgctatacccgcacataggacccgggttagggtgttcagaaaagcacataaccatcgtgttctcgcatttttgcgttctcctccttttcccccgctgactaaacaccttttcgatacccttgaccaaagtttcgcactttttcaccgcctggctagctcaatcggtagagcgtgagactcttagtccattgtatttcagatttgagattatctcaaggctgtgggttcaagccccacgtcgggcttttctttttgccccttggagcgagacatactactgtatgtactgtactacagtatatactgtgcataatgtacttttgttgcatctctagttctctgtcaccctactcgttcatagactttaggcattcattttctatattatcatactaatgcagaagcagcgagcccatactccactgctctacggtgttaattagtctatcaacaacactgtttgtttccttcaaacttgaaggaacgcttactttcctcccttcttctttcgcattcgcttctgtccaatgagctttccgagctccaggttcttgtccttttcaggctgtcgagactcatccttcttgtctccccccttgccctttcggtcaccctttcggtcttttcgatctcctcggtctcttcggtctcctcggtctcttcggtctccctctcgtcggggtcgcttgtgttcggaagaaccctcgtccgctcctccctcgtcgtcccgatgtcgcttcttctgcatgttgattcgagccatagtctcctttcgtcgcttgacaacctgtgcgttctcaattgcaaactcagccaccaggtgacgtcgcgaagaaccagtaagatcaacgtgttttcgctcgttctcctcgtagccctcaagaacctcctcagtagacacctcgtgagcgttcagccatcgcagcgccatgagagcagccttgtggtctcggaactccaggaaaccatatcctcgagatcggcccagctctccgctctccttctgctccataatcacctttgcctgtcggaccactccatgcttggacttggcagcctcttcggttcgagccttggtcgaccgaatagcctcctccttggacagaggctgtcgagcaccctccttggcttcagtggcaaattgcaccacggcctttcgacccagagccttaagacccttcgcgttgagagctcggggcaggtttcgcagagccagacgagtcagggacacgtgcagactggggttgccgttcagctgtttctttcgctggtcgtatgacttttgtcgcagctccatgtcggccttgggcagagtcatacccagagcagtgttctcgccgattcgaccctcgttgatcaggaagacgtttcgtcgatctttctccttgggcagcttacccagagcctcggctcgctttttcgaattgtgttcagacagcttgttggcggtttctcgctggacggcctgagtgacggccagaattcggccctcaaacacgtaccgagggtcggtatcatcagcaacaagcagagaagtggtggctgcagcaggagctcgctcaacacacttgtcgcagtcgtcggatgattcgaatgcaacaaaggcagttcctcggggctggcccgtggtcttgtcaatgacaggaagagcgtatcgaacagcaccaaagttctcaaagtgctccttgagagactctgctgtggcatcgtaaggaatgtttcgcacaaaaacggtcgaggagttggattgggccttgaccttgggagtatcatcctcctcctcttcctcctcctcatccacctcaatctcgtcttcgtcatcatcgtcaccctcggcaacgtcggcattggactcatccagatcgagatcttcctccttgacctcatccttgacctcagtatccacgtcctcgtccttgacctcgtccttgacctcgtcctcgtcgtcgtcatactcctcgtcctcgacctcttcaccgtccttatgtttcagccacttgtccttctgaatggcaaagtcaacggtaacagttcgcccgtcaatctcaagacccttgctttcggccacagccttgtcagcatgctgctttttgctcatggtcacaaatccaaacccactcatcttgcctccagctcctcggggaataaacgcatcgaccaccttgccgtacttggaaaacaccttgatcagatcctggggctcccgcaccgaccacggcaggtttcgcacaattagtcgcggctttcgcttctccacagaagtattgttgtctccactgctctcaaacggccggtcctctctggtctttcgctctcgaggcttggcaaactcgatctgaagaatcttgcccttgagcttctgctttcggcacttgagcagcgcctccgcagcatcctcctcggtcgtgaaagacacaaacccgaaccccttggactccttggtcgcagcattggtcaccaccacggcatgcttcacggggaagtcctgtgagaaaaagtccgccagctcctcgttcgtcacctccagagggatggaccgcacaaacaaatccgtcttgcccttgtccaccttgtcttttgtgtctcgaaccatttttttgaaacgtagttgtgtggtgtaaagggtgtaaatgcaaatcgaaatcggtccaggaaaatttccatatcatgcatattttttttggccttccaaaccttaaaaagactgatgccccggtttggaagtgatattggtaaacgagtaaacatctaatatgggagaaaattgcaagtaattttattaaaaaatcaacagttcttatcctgaagctcgtttcactactcttggacacttttcttgcgtgtatgtttgcttgattagtcagccacaccgaaatcgtgcgttttggagtgtggaaacaagacatagtgatcatagaacagagctgagagaaccattatgtagatttcgtctgggagattcttacgctatctttttcccctaattgacttccaattcaggacagtatataacggaaaacgatgtagtgtatagaaggcaagatatcacgccctaaaaaccgctacaaacatatatatcacctttgtgaagagaatcacacactacaaccaacgagatatccgtctctagcttaccgtattttcaaactcagctctctaggggatgttttcccggatcccgaaatcacgtgatctccaatgttgacatagtcttccagcatgcaggtcgcgatgcgatggagacgcgaacacaacacaagatacaccatgaagttcaatggcacgttaagggaccagatggtcctgaagcagaccacgaatttgcgacgaaacgcgctcaacaagtgttctcacaacacgctgtacaacctgactcagctgtggctggggtctaaagactgtctgccgctggtggccatcaactctcaggacgactatttattcgacttggacgcgctctcagacgacgaggacgacgctgaggccgatgaggggattgatgaagtggaggaaggcgttattgtggctcgaggtggtcccaagtacgaaaagatcatggacgatgctcgtaaagaactgactgaaggagtgcagtctcgaaaggcatacatgcagctcgtgggacaaaagtactggaatgccggtctcaatctactgcaactggcccaactggacatttggggagacgtttttgaacgtccagaaatgctggtttggagctacagtacagtgaaagattctgtcggtaaagagaaggtacctgatttgagcattggcaccattgccacgcgaatgagtgaggcaatctatcctgcctttagatgccacgtgcacgccatgcgtcatcctgagctgccagtcattgtggttcgtgtcaaaccatatgacgctgccaatgacgatgctcgtttgaagcccctgtacctggtgtttccctaccattcgcctcacgtgattcatctgagcatggatcacgtctacgcccaaacagttttgcatgctgtcactcagagtgtcactactgtggctgaccctatctccttggtccgttccagcgctctccccactcgttctttcaataccctggtgactactctttcggacaaccgaaaagccgcatccatgggctcctggtccgtctttgctaccggagaagtcgaccagtcgcctctggccatggtaaaaaagccgcctgccaaagtggccaactccaaggccaacagaattgcggcgaaattcacctcaaaaaagatcactgagcctctgcagtacagatcggagaatcctcaaagcatggtggagtttagaattacccggaactcgcggaaagtgacgctacggatggagggtacggatgtgtacgctggtgtgtacagaatggccatgaggggggacattaatgatagaaagatgcctgcttggatgactggagaggagagcagtactagtggagcggtgaatgatggggcttacaaggccgataagtagaagcaatcatcatgagcaacgcgaatgatgccttcttctgtttacggcactgatcatgaacattgccatccactgatacacaacgagtaatgcgaatgacatcttagcactgttattacggccacctactgtaccacaaatctctcttaccgctccatcatctcagtctatagccagacgtctacacaacttatttattgcatttcatattccagtacaaccgcgtattcaatcattatcatatcatcattatcatacatgttagctctggacttgttctcttacttctgagcaagtcgcagctcctcaatcataccctgaatctcttcaacggtggcacccgaggccttggactcgagttcctccagaagatctcctcgcttgcctccaaacgcctccttagcggccttgctcacatcgtcggccttaagagccatttgcactcgctcgtcaacgtcagcatctagagcagtcatagtgatgtattcggcggcgtttcgcttggaaccagctgccatacaggcatcgtagaagggtacatagccaataggagaccgtcgagaagtggcaaattccatcaacccggtccaatctcgacgctcaacgtatgcattcagcttgagccatgtccacttacgctcggaaatcttgaagtcggttttgattttgagagccttagacgcctggcccatcaccagcaagttgtgaatcgtgtctgtgactgagagacccaggaagttgcactcgtagtcacgttctagctgttcctgcaacttcagtagtttggactgctcctcgatgatcgcagcgtcgcccactgagccatgctcggagtacatacttgcagcctttctaaagccctcgagtttctcggagttgaggttctggcctagggcgttgagatagacacaattggccgagtcggtctgtcgatcagactggtaatagtactgctcgagagcctccttgctgttgaccttggcattgttttcgtacacatgtgacgcaatgggaaactcccgaataagcttgtagagctgtgccatagacagagtatcttgtaaatgcagctggaccagagtgatgagatcgtaagatcggcattccacagccttttctagggcaagtcggtcgtctcccagttccatcaataagggaacctgcttgtacgcatctttttcctgctcagtaagttgggtggctagtcgtactcgtccgtcttgagctgcctggcgcgcaatttcgcagaatgaaacgcctcggcggtccttaagccggttcatgatcgctttgtagagctcttcgtcggtggactcgggagagtgaaagatctttgaacaggcccagttaacctcgatggctgaaacagggtactttagcacatcagcaatgttgaaacacaactggtgcaggcttcgtagaagcaatcgctgaatgagtttcttgggacctagcagtttgtactgttggtagctgagacaaagaccaacctccgactgccgcacagagttaagaacacgcagatcatcgcacacctgcacgaatctctcgctgttgtaaatgtccagagctgactttccaaaggcagccgcccgaagcaaccgtttctgcaaacttggagaatcttcatttccagcagcaagaatacagttgtcgacggctgtttggagatctgggccaatgatttccaggttctcccaagctctaggagactgcttatcgaggtgggtcacacagtcgagaagaatggctgctggggctaccgatccaattcgaaagatggataatgcagcgtcgcagactcgggaaaacaagtgatgcgagttgtttcccataattcggatgctgccatcgtcttctcctcggatctccaccgctccgtccccgttgtaatacagggtgagctgagagccgttctcccggccaaccagagatacttcgtcgccaaaggaaatagcgacagcgtcctctcccagccaacatagtgttctgatcggctggtccacattttcctcgagctcgtacttgccgtagattctgtccagtgaaacgtctcccattgttacgtgagtgtttcctaccagagccatatggtggccgctgggagagacagtcaggccattgaacaccggctggacctcagcctttttgtcaaacttctttgtgctggagtccagcgagtccagagtcatcagtccctgttctgttgacgccaccacctccactcctcggctcatgctgacttctggggggatgatgcaccacgagtggattttttccgtcacgggctcggctagtttgcggggtactggagactcggaatgggctctgagtacgccaataaattggccattgttgagcagacacacaaaaccgctgttccaaaacttggtttccttgactccagcggtctcagcgtccagaccgagactgaactggttgaagttgccatggaagtcgtagtagacccgcaccgagccctggtcgctcacgaccaccagcttctccccctcagtggtccatcctaggcctcggatacgccccatgtcccatggcagacgtcgaatcaggtttcccgagcccgaaaacacacctatcgacatttgacgagctgcgtttcccatggccacgagcttgtgctcgtcgtcggtgaccgccaccgctcctcctccaggtgccagagccaccaccgacgaatcaaagtcgatttcccgtccgtctcgttccagctcatagtcgtactcgtgggtggagtagaacttgcccgccagttgctcccattctgtgttagtgcctgagaaaaaaaagccaccgtattgtactcactcaatgccggattagatgccattgtgttggtgtacttgtgcaagtgcagttgcaacagacatattggtgcatgctggcatctgcatgagattaggtttacacggggacatatagggatggggttgaggggatagccggtggcatttaccgaaagtagagtatgaatagtatattcctcgtcacattctgagtagattaaagcttttccgggctcaaaacctccacttttgacgaagatagaatgacccgaaatacaaactcttagttagatttattaagtaatttacttgatgattagttagttccaagcagttgatagttgagacagataaccaccattgccgccacaaatgcaataaattttggcggtagttcttcaattatctttactaccagtcacatgggcgatgccacttctcatatttctccctacgagcatatatatgccgtttgcatctcaccattccactttctctacttaactccccatctgcatgcagctaaattgcaacaccttctctactccttaacattggcttcttctacacctacacatcgatatgtccgctgaagaacaaccgcaggaaggatacgtgggacttatttccagcgacggacacgagttctggatcaccaaggaggcggcctgtgtctccaaggtgctcaaacccatggttcagggagacggacattttcgagaaacactggacaataagatcccactacaggacattccccatgacgtggcagaaaagctgtgcgagtatctgtactacagcttgaaatataaagatcaggtgagcgatattcccgagtttgaaatccccccggagatggctttggagctgttggtggcggcggactatttggatgtctaaactattcccgagtgatgggaatgggccaccatacatgctgtgaagccacatgatctacagcaccgactggacaaacgtcttccttgtacgccgcgggcctttgcacagcaagtacgacaagatttacaacaacgacaagatgcagtacgacatctcgacgtatcgtgtgtttcaagtctggtgaaggtgatgttccacggatgcgtttaccccccagtcggggcgtgacgactacaggccattcagacgcgtcttccaccttgatgagctcgtagcatcggggtttgtccaacagtcatagcataatggaagataccaggttttggtggcgtagacagtgactcggtaggcgtaaggcgatctcagctgcatgggcgtgacatcaaggagttatatctgatatcgcgttgccaatcgcaatgactatgactgcgtgacgttctttgagatggaaacacagtctggtgacattaaagaactatttctgtacatgttgatactggaccttagatgttgagtattaccggctagtccaccgtcatctgtcgctgaataatatgtttgagtacaagagagagattttctttggtactgtatatgtacttgtacaacagttcggtgaaggaccaggggagcttcatggtacttgcactccactaatgtccactaaattcccaactaacggtaacttctttttgacaccaagacggaattatcgaatcatttgcgatatgaaaggttagatgcttcacttatcggtttagaagttgcactttgtctatcgattggtacaaattttgaattggtagctttatgggaacgtctgattgtctatatttttgtctgaaaatgtttttaacccctggctcattaactaaacaaaatctcaacaaaacatggctaatttacagtatgagtccaaattaaataaaatagattaatacaaaattacgtcacctaaagaagagcaacggcaacacctccaagaacagccatcattgagacggtctggacaacaccgccgttcttcttcttgtcggtagaagaggcggaggcagagggggaggaggaggcggcagccgaggtggcggagggctcagaagcagaagaggcggaagaggaggcatcgggcttggcagctcgcttcttggggtggccgttgaacaggttcttggcgtcaatcaccacagtagggtccttaatctcgttaccatccttgtccttgatggtgtagttggtcttgaggttctgagggatgtcgacaatctttccaacgttgttgttgccagagccagacttgatggtgtcgagcacgggagaaggaggcaggtcggtggtggagttgaaggactggtcggtcttcttgatcagagtagagttgcactgcttgatggtgggctcggatccgagagaagaggcagagccggagggcttggagatgttggcgtaggccttctgcaggttgtagtagtcctccttgagctcaatgttaccatcgctgtcaatttcgaccagaccgtagttgttggcctcctcagagtactcgtagatgagtcctccagagaaggtgtccttgaggccgccgtacaaaccctggtcgacctcgtcaaaggttcggggtcgcaccttgttgcagccgtactcggagaagatgagggggatggccgagtcagcgtaagaggagttgatggtgccgtagccggagttgtcccaggtggcgcctccgcaccactggtaggtgttgaggccgtaaaagtcggatcgcacctcctcgtcgccgcactcgaggtattgccatccagcaataccgagggtggtatcatcggcagcagagtagccgacggggatatcccggtctccatggttggagatgtaggccttcatgtctcgctgaagagccttgatgtagggaggcacggtctcggcgttttccttgttgttgaagacctcgttaccggagaagaagcccagcacgttggggtagcccatgaaggcgtccaggaagccgaagactcggttgacgtaaccggcgttgtaagagcccttggggtcgtctcggttcagcgactggccgcccaggggagtgttgacgtccagaatcacgtagatgccggcaccgttgagaatggacatgcactcatcgtggttgatccagggagacagggtgtagactcggatggtgttaacgcccagcttctgcagaatgtacgcgtctcgaaggcacgtgtccacgtctgacagcgcgtccgagtcagccgagtccgagtagccagacgctccaccgggctggtagtcgataccaatcacctggaagatttcatcctcggaagacgagttgccgggcttgacaaacttgttgcctcgaatctcaatgggcacgagggcggacacggaggccgcgagagcggatagcgagagaatagaagttggtttcattttttggggggtggtgacgacaaattagtggtgtagagaaaaagaggaccctcctggtgttataatttacgccatagagttacactttggggatactgtgcgtaagtagagttacggtttgagggagtgcgggtggggagcgatgatacttggaagtaaaaactacgtttgtggtgtgacgaggtgtttgttggggttgcgcaatatttaaagctgcgggcccgctcagttttgtcatctttctctgccccatttgcctacccaaaccctctgcgctccatctagatggtcgatgctaacccgctcggcgtgcattccaactctaactggaatgtaaggtcatcgaggcggcctgcgtcaacagcgcggagaatgtgagcagtgaaaaagacgagggtggatatcgttgtcgccgcggccaatcatgtgaccgcgaaaaaagaaaaaaaatcccgctgactcatcgaccgaggaccctttccactccatctttcctggccactcctcctgttgtgcgagtccctctgacaggggtctggaataggagacaaactatcgtgtcaatctcacacgcgaactaatatacgcagagcgtgattattgacgggagacgcaacagagcacacagcgagggcaagtcgcaacagacaaaggcatatattttaatcgaccgccggtcacgtgacgaaaacagacgctagcgctccaggcacctaccgcacgcctcatcgcttggtccatgtcaaaaggcttgttttacagatgtcagccacacccgtgccgttcttaaaaataacccatatcgcctaaccttgaaatccccgcatgtaagcgaggtttgggttgaaaaattgagggggaaattggcaaagaggataagtacagtgaaagtacaaatacattgtagtaagtgcgagtgaggaagacggatgggctataatgcgagcaatgatacaaatttagttgttcgtgctgaaggagaataacagtgtgttgttgcgtgttgatgtggtgttggtgtgagttttcggttgttgacgttagtgttggcgtgttggtgttgatgttggtgttgatgttggtgttgatgttggtgttgatgttggtaagttattgagtctcagagtcttaagaaatgtcaactaaggtttcaactatatgtagttggataatttggcaaacacgtatacaatacgattttggggggttatatgacgattcgaggtatcaaatgtgaatcccctgaattgtgtctctcaaatggtagtgatttcttgtcgataaaatccctggaaggtctaatagtaacccccaggtgaattttctcgttaactaaaatctcaactagttcaactaaataaaatgaatatgggccgcatctataccaagcggaccacatgtgggtatatgaaggtgctcgatttcagttctttctagtcatgttattgtacaagtagtatagtacgagtactagtattcaagttccataagccccctattgcacaagtaccgtcttttctgcccttcctgtcgcagatggtgctttgttgagatggtacgagtacgactacaagtataaggatgtacaatgatggatgtactgtacatacaagtatatcccaggtaacaaaagtctgtaaaattttgttctgctccacgaaaggagaattgacttgaatatcactcgtcagtgctgtcagctacaagcatcgatatttccctggcctacctccactcgctctacttgtacactgcgttccttttttcatattctctaacctgactcctagagcggacaaagttttttttttttttatcttcttttttttttcttgggtaaagacaggacatacaagttggcgtgcttggagtgggcatttgagacgcacaaaaatcatcttttctttccgacaacacagaaatatatacacacggtggcggcgcgacaccacacagccatggggttcgtgggagtacaacaggcgtcgtcgcgacccactggcaagacaagaagacatccgcctgtgacctatatgaagcgccgaatgctgattcctaaacatcttcgagtgaggaagaaacgaaaacccaaccacgtaccttttctcgacgggcttccgctggagattctagagcagattttcgtcgagtcggccaacccggacttggtgctcgtcaacaaggccattttctccgcgctcaactccacgtgcatatttttgcgctccagcatgcttctcaactgggttgagaagaaggagcccgagagagtggagaccagagaaaccacagctacggcagaaccggagcaacaggagcaacaggaacaaaatggacagaccggggaaatgacacaggagcagatcgaccaggacatcaacaaccacattcatcatcctcagacattccatattgacgacatggtggtggatccgccggcaccaccccaacaggacaacactgacatcgcccagagagccccagccaaatacactctgccggtggagcagctcaagtggaagtttgtgacgagagagctgctggagagtctggatgttgaagtctcgggcacttacattccaagtacctacgcagctgtcgacgccacacagcgacagaaagatctgctaccattgctcaaaaagagcggcctcaagttccagaacctcagccaggtgatttccaaggctgccatcgacgctgaccacttcaagcatcttgtcaaactcgactttggaccgccgacaattgcctgtctgatcgctgctcttcgtgctaccaatggagaagacctgctgaaaagcaggagcaacatggacctgctgcccaactggctcatccggtccggctattacgtcgacaaactgtccagtgacgagctctggagcttcctggtggcctatccggacagaaatctcgtccggtactttttgcagctcggtgtcgttcctagtgaaagactgttgcatcagattcctgccttgtagagtcaaggacctactgatatatttattaatgcatttatataactgatcgatggcgtatgtacttgagtctacagtaagtaattaaacgaatcttcccaaagactagtgtcaaaataaccactgaaacttcgcggtttcgattgcacttgtttcgggcttgtaacgcctttagtacatacgctggtaacgagaaatatgctctagttgctggaatgttcggtgattactgaagacatgaatattgtaccagaactcaaccgacaaaagtgctataccggataaggacatgtcttactacaatcccgcccgtattgtacctgctacccttgtctgtgtactctttgtctttctgactaagatttatcgtgtatcacgagcgctattatccttagcgcgtatcgaaacctaacaaggaatgctgatacaatgatacgagtggatgcgacaccagcttaacacggaagtcccgaactacaaatacacgttcttgtcatctacaacgtctttccacttcggaccatccccccgcctccaaccccccttctaggtcatactcatgcatatataaataaatatcgtcagactctctggcgcgctatatcgccttcaatgtaatagtcctcgtctgagccccgctcataatcaatgtccgtttcgtcctcctccgtcacctctttcgagtgcatggagggacccttggatagtcgttgtggatgcttgttttggtttggtggtctctgccgctgttctgaaagccgccgaagttctcgcgacacccgaggattcgtcatttggcgtgacagctcgtatgactgccgcggcagctcaaacgactctctccggtgtgcggcatcggggctggagtcgcccaccacctcatcgtacactggaggcgtgctctgacgcatctctggtgatggtgatgagtcgtggccgtcgtagagcggcagtggttcgtctctgtcctcgtcctcgttttgctcccgtgacggttgtctgttgcgttgtctgtggcggaacgagaacgccgagtaccaaatgtcctgacttggctcagtcatgttctgcgagccgagatccaggcgcaatgcctggttgcgtagcgacgcccgtcgcaggcggcgctcattggtcctgcggcgcctgacacacgcaaagatgacgatgcatacgagggccagaggcaacagcaggaagaagagccataggtacttgaggttgcgcgacgagcctgaatcttcgtcgccgtcgtcggaccatgagtccacgtcgccgtcattgtccgggtctgttcccgtcacgttggtgcccggcagcttgaccaacaccatggtggaattgtgttgcttgccctcctttttgtggtcgccgccctgcgacatattgttatgcacgacggtggcgagggccgagtagttgaacaccgtggtgaatgtggtcttgtccaacgagaccgtgtatgtctgcatcaccgggcggctggtgtgcaccgtggttgaagtgtggttttgtgttccatgcgaatcgtgcgacgagtggaaggtggaaaccgtcaacgtgtctgcacctgccaacgtcgccaccgctgccagcgctagcactgctctcattgtggaacgggcgcggaaggagtagagattctggtgcaatccgagagtggtgagttgagcaaggaggcgatgttaaagttgttaagttgggttggtgcgtttgtcaagcagtggtgaatatgtagtgtacgagttgtggtggtcataaaagcgactgtttatcacagttgttgtgtcgcgggtgaaagtgcgcccctgatgaaacagtatatatagccctgtattctctacttttgcaccagtcattaccggtaatactgctgccgcaccctcgaccgcagaacctaaacctcgataatagtggagctatgcacaagccacctgtcaaggtgcatactccgacacactacctccgagaccacggactttgccaaggagcggattagtgtcatcaggggcttggaggggcgacagcctgaggcatggcgcgcgtccgcggctgtatttggctcgactttggcacttgttgcgcctcggaaaaactctcaaaaataaaacctcggataacgacccttgaaccgcctctttatgcggcaatatctccacgtgcagagtgactagacggcgactgaggtgaggatgcctgagggggcagagccgcgtgcagagcgcgttttgggcggccgttggagagcactcagagggctgtataccacgtgctggattacacgtgacggccttctacggtctcctcctaagatcatctcttcgtctcttatcgcaacaagatttacattgttgtcaaaaaaaaaaaaaaaaaaaaaaaaaaaaaaaccctgagcataagcactgccggatgtctcactgaaagacaacaattgatgactgtcgagtttctgacatcctacatggtccctatacgggagaaaaaggcgatacttgtacgagtacgggtattcgcagttatcagatcgtgaggagacgaggtcacagcttacaccgaaaatcctctaactatgatgtccgttggtgaaatatgcatccatttttaggacagtaggagcatgatggggcaagattttgccgataatatcggcgaaacgcgaaaaaaaaattcgccgtagggtagagtctgggtctgtggtgtatagggaaccgtactgaaccggtatttgttggcattggccggtattggttggtattcgcagtacacatttccaggagcagtggaagttgtacagtacgagtacatactgtaacattgtgtgactcggttgatcgatataattagtcgatatactgagacaacgctgtcagacctatgagacagagctcacggaggcaagagagcccaaaagattccttccgacgtattacgagtttcttccattccatgtcagatcccgcatctattaatatctcgttacttcaggttattctctgctctttcagactgtccctagatactgtaattactgtgcagtatgtattgtagttgaacttatctctgaattctaaccccatagttagtatctgggatactctaactgtaattcccaacaactccaactacaatacaaagacagtctaaactcaagcagcccaaggcacccacataaagttcatccaggcaccatccggtacagattttgcgtgccagtatcaaatcaatcgcatcatcaactcgtacaagtacctttatcatatccaatcgtctttgtacgcgtgaatccattaccatgcccagtgttcaaagcccattggagtctctgaaactcgggaaaccgagacctgaatacgccaatgtcgaatcacagctggaagcgcttcagaaagagcctcctaccgcgagatcgaccccaaactacctcaatgtgaacttttacaagttggggatcgctctgtgtttcttcaacggcgctctggactcggtggagtacttcaacaaaccgtcgggtaagttttcgcagtgtgctccagggttgtatccgtcgtggttcccagaccccaacgattcgggtaaggacctcgtcatcaagtttggggagccgctccagaaaggaggaggaacgaaaaaggaagccatcgacatatggctgcgatggaagaacttccaggtggaaatgccgacgaaaaactgggacgaggccaaagacgtggtttggtgtcagttggtggtgttccaggagtgatcctagccatcggtagcagatttatgacagaattcagttgaatgagtgcttggattcttttcggtgcagtcttgccgtttatacactcacaatcaacctgcttgtcaggcataatgctgtaaatgaacagcattattggcacaagtaatgatcatgatgagacgtctaccattaatgctcgcacttatatcaccataagccccatggctccgatcatcatcccccccttagataacaattggggctggtttgaggctgcacaccaacggcgtacatatacaagcagctggcgtacaagaaccatcattcctgcacacatgatgagagaaactagcaacgcaacatcctacggaacggtcgaaaacgagcggtttctgttcctcgatattcccggctgcagcttactgggtctctacgtccaccggcagtctcgttccctaatgtgcagtttttccaaaccgcaggaagaagaccgacagcgcactgtgcacaagactctggagatctctgccgatattcgtggagactgtgactgggaatacctctatattggcagagagtcgcatttctacgtgaaaatagccgctgataatggggcctttacttacctctacaactcgcagacaaacacgttcaccaagatacgccagtaccagtacaactcggccaagagatggtaccttgaatctcatatgccgtcacccgaggaaaagtacgtgtctaaaaccagagacctttcagcaggagaagagtacatgtttgttcggagatcccaacctgagccttacaaaagctactgtaccacagaaaagtcaactctgaggaaggataggatgatcgaggggccttcttatatcagtgacatctaagagtacagtacactgtacatatacaatcgtggacaggacattatgtcgaaatgtgaccgattcagcgacccggagaccaagttcggactatttccatcttcaatatattctcgtttcaatcaggttctcattatgactgtatgagaagtgattttcattggaacagccccaattttgagactttctctgtatatttagagtttctgataaaagataagataagaaattttaattttctcataaaacattttatatactaacaagtacagtacttactgtactgttcttgtactgtaggggatgtaagtatttgtacgattccgagtacttgtcgactggttaatttgagtgattagtaaacaacatactgctgtaacttcagcaactcttgtaagcactccgatggcgctcgagtagagacctctctttgaaatcactcaagttggagtttcaatctcggtttcttcaacaagctaacaagccagagtggaacctgtacatactgtgcgatatttgtacttgtaatgatgtgatatatactcacacatctgcttaataatcaactcttagatggtatttctgcaacgaaatcaaaggaacctgtactttcaaacaactaataatctagagtgtagctacaggaaatgtacatactgtgcagcactcgtacaatatgtgatgtacctgtacttccgattgtttgggcggatataacgagttgaggttatatggaaatatataatacaagtttgttccttgtcacaattctgtttaggatgctcgtcatcccagttggcattgctcatcgtactgtccgactactgcatctacaccacacaagtcgaatggacatcgaaaccgcagagacgagtttggatgaaccgatattaaccagggggagcctgatccccactatgaagttgacttcttcgacgtcgctctctttgcgatctatttctttgggctggccgaagttgtatcttcaaaacacggggaaagagatcaatggaataattctctttcgctgaccgaagacaattacagtaccagaagtttgatcaaggtgtttatgggaagttctggtgtgttcctaagagctcatttgtctcgccagtcaaaatggtcccgcattgggcttgtgcaaagttcaagtcttccgaacaaatgactttggactggagctgaaagatttaaacaaacacaacttctggggccagtccgaatctaccctgcatctattagattatatgaacgagtctccgaagcttctggttgagcgagtccgtcatggtgtaccatcatcagcaatgtcttttcaggacagagatcgcctgcttcgaatgagacatactgccatagcaagaagggcaatgctgtttttctaacttgattctgttttgccagacctgacatcctacagacacgcaggaacatctggcagacaccttcagtcaacagcctcagaagaaagtccgtcagcggccaagaagaaacgtgagtctgataaacctgaaagtaatgaagcgaattgtgtctgaagacaagaatctgaagagaaaatgcctgtctgacgaagagcctttagatgaaccggaagaacctgaaaccgctgtgattgaggctccaagaggaaggaaaaacctgccgagattggtgcagaatttgtacttgtagcaagctgcgtctttctttgaaaaacaagacgctcatcagtttgtgttggcttgacgagctttccagaatattttactgctagtataaactgatttctcatcagggagggccgactatttggtattgtagctgaaaacgtccgagcgtagcgatacaccaaagcgcagtgttactaaccatctaaaatactggtctgttgagcgggaaaaaagagagaatctcccgggggcgagtcgaacgcccgatctcaagatgacaattttccattacagtctcgcgccttaaaccagcttggccaccgggaggtgagttttttttggaaatcaatcaaattcagggaacgtgaaagtagtcgttatatactggtagcagtgcttttaacgcagtgttaacgtctttaaatgagacggaagttcattattcatacaatctccagcggacttggggttctcctcatttctcttgattttatatggattttccccgtattatgcactttatagaaggataaatacgagaaaattcataaatattccttgaatcattattttttcgtagggaatgatttttcggttatattaggtgtcctttctaaaccaaagtactgtaattaacacccacatatcaatgtcagatggtatttcgatgtcatctcatttaatattaaaataaaacaaaccccaatataagattcttgatagcatcattcatgcatgatcttggaagtcctacttggctacactttcatcccagtgtgcgaatgacagcaagtgggtcgtttcatccgatcatgactgagcaggacattatctttacggctgggacgcctgccaccgagctgacgaccgcgcagcgtcactacgtccagtacatgattcagcaggtacagatcgaccaacaggcaacttttagcggaggagaaaaagatacccaagccatattgaaatgggtcagagacatggaggagcatttctacggcctgtttgtccagccggaactgtgggtgattctggcggctgtgcggttaaaaggggaggctcggagctggtttgcggaggtggaaaaggagcacatttttggcgactggaaccggttcaaaacggcattcattgaaaaatggagtcccgactacttccataaagtcatcacagcttaccatggaatcaggcaagatgaagaggagacagtcgacgacttctatgccaagttccgactgctgcgagataacctacccgaaagagatccagagtcaattgctaaggtgctctttgtgaacgccctgcggccaggcttgcatgaaatcgttgtacgccagtttcatgattcggttgagtcgacctacaagaccgccagactcgtaatggtgctgcaggacagtgttgagagcagcacccgagcaacaggcagccagacccagaaagctacggaaaattttggtgaccagaatagccagaaggcaaacaaagcgactcggactaataaaacgattggtgttaaggcatgcttcttgtgcaaccaaacaggtcacttggtcagggattgtccccagtaccaggcgaaattctgcttgcactgtcgcactaacgatcactcgactgccgattgtctattcaaatatggacccaaccgcaaaagagacaaaaaagtacccatctgttacaagtgcagtgagagtggtcatattgccagagactgcacttattctccgtttggtataacctatgtgcgtggtcagtcaaccgctggcaggtcgtcgtgctcgcctcctaaggcagctgttgaaaagggaagcgatacgagttatgccgaaagttcgggctcacttgagggagctatcgaaacagcaagcgatgctgaccgccaagctcaaagtgatggtgatgataagctctctgaaatgctgggatatggtcatggaactgactactccccaccgtctcccattacaaagtgttttcgttgcagggaatttggccacttgactcaagagtgcactgcccctctggaaatgtcgcatatcgaatacacatcgaaggacaagtgcctcaggtgcaagaagagaggtcacagagatatagactgtccggaaccaaatacagcagagaccgaatccctcgaggctgagacccatgagactaattctgtggcttctgcggactctgtggaacctgtggacctcattgaaaatcagccggttgaaatatctcaaggagaggttcattccaccgaagacctggggtttgcatcggagtaaccgttcatttttacaaaacattgtgtggttcgggtaatgtgtacaagtggtacatatggtacataatacatacatacttaggtcattcaaacatgcgattttattccagtctataagtacatttccgtgtgtaagcaccgtggctgttcatcccctttgcttagtcaaaagtcatcttcttaccagtgcttttgacgatacccacagaggctctctgggcactggccaggacctgtccaggcttctttcgcgagtaaggtcggtcctccttgcttctcttaggcttatcgtatgactccttgttctcggtgtatgcaggcttatcctcaacctgggcaggctctgagtactccttctgtgcggactgactctcgtcagcgacagcaccctcgacctttcgaggcttgggcactcgcttacttcggtcttctccggcctcgagacgcagagttcgaccctcgaggtacttgtacaatcgtcccttaagagcttttcgagtagcgtcggcgtcgtaaaagtccacaaaagagaagccctttgacttgccggtatcttcaaaagacatcattcgaacccgtcgaatatccccgcaggacttgaagtggtcctgcagcatttcctcggttgcgttgaaaggcaggtttccaacaaacagcacccgtgagtctgtgtctgtagggtccttcttctcgggccgtccctcgaacgagtttgcgttcttgataagaagttttcggccgttaaggatctgctctgacaaggagaccagtcgctccatcttctcggcggtggggacgtcaacgtaggcgaaacccttcaccttcttggtaaccttggacttgggcaggttaattcgaagcaaatcgtcctcctcaatcaccaccgcgtcggagtcctcttcagatttacccagcttagccagaatgaaccgcttgatatcctccttgcaagtgtcgaacgacagattgccaatccacactccatgttcggactttttggacttgccctcctcctcatcatcggccttctcgacaggcagctttcccttcttttcgagacgcttctgtttcttggacagaggagcggacttttccaagtcgatctcaatttcctcctcgatctttcgcttgacggtcacctcggaatcactcatgttgtggtggtagctgaattttgtctcgaggctgaatttttttcagataatgcaggccgccaatagagtttgagggtggtcgatttttttattaatgagttgaaaatacgtcccaactgttgaaggtaatacccggtggggtaatacctggctaattcctcacataatgatgagatgtcaccacatagtaatgagaggaatcagctgggtcgtagacgagatgtccatcctgtagatagttttatccactgatctagaatctcttttctggtgaatgagcaagcacacaccagaagggtgtgtgctactatcggaacgccgtgtccctagaagtgggttgtaagttgttaattaactatatcacatcaataatacttatgatcttcaataccaactatgatgcgaactcgggtgcattggaattattcaaggtggagaggtgacaacggtaaagaacatcccaagtattattgattaaatatagttaatttaccgacttacaactcacctaaggcggcgccggctatcctcaccctgcccagaccaatttctggccctcctgctttcagatgcttcttcccttgtaacacactcttcttactatttgtcactgcctcatacagaccttcacctttcttcaccttgcgttttcccatctattgggtgaagtcgtcactatagtatcacaaagcgattgctgacctccttatcaaagaaaacgcctgtcttctttggggtttcctccgacaccattctcaaagaaaacatcactatgttcacaacagagatgagtgtcttttaaagaatcttggtaactggtaaatcgaaagaaccttcgaaatggcaatgcccaacgggagatagtgcatcggctaaagagggattcaaacacttgcaatgccagcttgtgcttcagagttctgcggctgcgtatggtggctgaattggtgactgacttggtggctgattgtgtggctctcgctgatctcaattgtcacgatggcaactgttgatctcactgatgaggttaccaatagtaatccaagttgttgatggacccagcggacgtgggacactgctgaggatgtgcgaaaatgtgtcgtgtacgtatcattttcttgcacttctggcacttgtaatatttgacggggatgtatgacatgatgtgatcggagtgaacgttggatggcgtagcttgctggcgctacaaggataaccgccctctatatatgtccgtcctgttaatcacatacccaggtcatgactcgatctgtttcatcggacaaacgaaatggggattatttcagaaggaacaatgaggcttgcactcatgtgcatatcaacacttgatgaacgcaataaagtgcatattggcacttgctgtaagtgctaatcatgcgaagatgaggatgacctgcttgtaggctacgatacgatacctgtatcgtagcctctgggactcatttacagtgacatgagctcgatgtgaggctcaaatacccagttcatgtggcaataatttgctaggtccacttttgttccacacataataaagcatgttcgagagagtgtattattatcaagatacatcactgtcggcaaagtcttcgtctccccgtctgatacaaactcgtgtcttaaaaggagagataacttctggatgcggcttgagatgagcagggatcgcgacttggatgagcaggaatggggcacagtacgagcactgttctaggacaagtgttgttttgccgatacattataatcgtacatcagcaggatttcatttctagactgtgagaaaaattacgatactgtgagaaacactacgatattgtgaatcggtgtcttgctatgtcgacagtgttatttctgatacatcacgtactctttgtacattgtttgggtcaccgggaaggtcataacagcatttggttttggggcaaagtcgtcagcgtcagaacgaggtttgggattcgatttacttgaagtgttctatcgtacaactacaacatacaagcgtctggttgggcaatttgatgtgatacggctattgtaaaaaatgctcgatttttactacaacttttctacggaggttcctgtcgttacggttgacggagaaagagtggccgagaatttgggctgcttgagaccgccgagcatgccaatccggttcgctttgagtctccctgttccacaggagctttgccctaacctgtgatatctgcattggttcaaggtgtcggtgtggcaaaggaagtggtggtcaacatcggccaccagtaactctccggagaacggaaaggctacaatcgacggaaacagccacaatcgacggaaacgaccacacaactgaatccataatccccagagttggctacctttacccattgctgaccaccgcccaagtaagtgcctcatatccacaccttcccattagccactgggccattcaaagttctgaggtggtttgactttgacttgaaaaaaaaataacaaaaaaagttcattggccccaaccttgatccaacttttcaccgacgtttttcaccattctaaatccgtccactgtacgtacaaaacaatacttgatgtttgatgggataatgttgggtataggtgcgaaaatacccgtacagaactgtactcatactgtcaaaattctcccaaattcacacctactgatggaatcacgaatccgccggccaacctaagacaactccggctctctcgaccccggttcgtgtaactctcagtctgcggactccgccatagccactgccttgtgcgcgccttgtgagcgagcggtgacacggaaaacgctcgcacgatccacctggcgatcgaaaccttgtaacttgcgagaaacgggagcggcactggtctctaacggccgaggaattggatatatggcacggatagccacaaaccagccggaaaagaagggaaaacgagtatcgcacgagcagagcggaagactctcgtcttgaaaaagatcggcttcgagatgggcctattgacctaccaccattgacccgtccccgagcctacgagtcttcgattctagaggttcgccttgttcgcatttgcagtctgagttcacgagtgagacagggccagaatacggtccggtacgaacacccgttgaataacacggtgaaattccacatgataaaagtaggggcaaaaccaactgcagcctacagccaagccgacgcccaggaagtaggggtatgtgcactgagaggagtgcttatatcggtggaagcatacaaggatgtgtgcacatggaagtgtgccagacatgcgttcttcaggcttctgctctgtgagtttacctggataaacctgcagttgaaaagaaatatcaatgggcagttaattgactggtacttgagtgttgatgcggaaatgagggggtgaatagattctcaatgtgaggattcgcactaacaatgacaagaatctgtcctgttccaccgcctctgtaccgcttccactgaaccaacccactaaatcaacctcggttgcttgcgtctctcaagttagcacacattatccagggccacagggaagagctgtatagtttatgctgtacgactggggtatgagttggtatcgtacttggatgtaacacaactgacggctttcagggaccgtgaagatcaatacctaggcggttgttgtctgcgacatacgcatccattgagaagttggaaatacgttttgaaaaccgttttccgggggttctttcaccgtatattcggtttgccactctcgctttcgatgcacgctttcacgttgggcttacagagaccgtcaggaccaatgtcgatcttttcccacacactcaaccttgggacttcacagtcaggcacagatcgtgcccgcaactagtcgcaagacaggttccttctagtgtaatggtctttctaacaccatcaacggttttctagctgcaagagaatcagctacaagagaatcagctacacccgcgtcatgaaaaaaccaccacccaaacctcacttggatttcctctttagtatagactttgaaatagcgttgctgagaccaaccagtaactgagctacgagttagatattattcatactgaacaagtaataaatgattctcccaagtatggtcgatgaatgtacgtactgagaagcagccaactcacaaagtcgcattacatacacacaaagtcgcaatcaaaacacacatttcttcctgtaccgaacctgtacaataggaatactgtatccacccaacaaaatctctttgtcgtcttttcacgctttctgagacagtagatttcaggccaccgctatcaggcatgcaaatcaaccataaccgtaacctacttggccacagaaggctcaggtaacggtgtcgatggagggttttcaggcaatataaacccgaggggacccttctcctcggctccccaagccttcttcaccctagtcattctcttaccccctttttttacttcaccctataccctctttaatcatgctcttcctcaagaccattgctctggctgccactgccgttctcgcccaggtgtacgagcccacctctgatatccacttttacgcccagtctcaggacaatgtggctccctggtcccagtctcttctgaccgtccaggactctactctcgtggctgtcaccaccctgacccccaacgataccacctctgccttcgacacccacgatgacaacttcattgctcgaaacggcaagttcctcgctgctaccgccaacaacggcctggtgctgtccgactctgctcccacccggcagctcaagtgggtctctggctctctcaacgttgttgacaacggcaagacctctcagctggttgcctgcccctccactgccaacaacacctgggttatcactctcaactccaactgtaccaagggtttccgagtcgctgtcaagccccgaaccatcgccaagaacaccaacaccttctctcagatccccgtcaacatcacccactcttcctccaacatcactggccccgtgtccatcactaagcccgagcccgccaaggaggacgataagcacaacggagccatgaccaacagcgctggcgctgtggttgttgccgttgctcttgttgccgttcttttctaagtgacgaccggatcgtttcaaatcacattttgccgtttctggcttcagaacagacacacaccaccaatgacttcgcctcagatcgcagtttttctgctcccttaaaacaccaaaagatcagattccacatcagatcattcagattcatgtatatttatcattcaatgcaggcaggttataagcaggacgctagtagacagtagtagactggtacaagtatcagtccactgatccatatgtaatcccactaaaaggggactttgcaagacgtggtaagcgcaaggcagccatgtcgacgtcacctcgacatggaaaagtcctcatatctagaccattacgatcagaaagtccatatatctgtatacatttggaatcagcatcaactttcgagttgagtgattcaaagccacgatagtatggtctgtatcgtacaatgtacttgcgaccactctctgatgctgtgtaaaatccaagagataacaccagaaatacaaatgtgtcgacaaaatctgcaatactagcctatctatatattctttttctgattttattccacgatcaatcccaactattgaccccaataatctcatctaattacttgtactctaattacttccgccaaccatccatgtctcccaacatcatgactcacgcgatgagaatttgactatttctgcgacaataattcgggtggcgttatatatatagagggcgcaccggcatatatttttttcctgccacctccccagtacaatagtttatgtgaggagcctgctgtacctgtgcttctggtaaaagcaaggaggctgactaacgtactgaaatgtacggtgacagactgagatgttccaaactctatagtgaaaatatggccttcttgtgatgcgtcatactacgaggctaccctacgacacacgcaaaatgactgatttcgaagacgctacgcctgatgtggtgattggaggcgacattgtggccgagagccagtattacgaggaggaggacgaggacgacaacattgttgaggagacttccgaggtcaagaagaccgtcaagtttgccgatgatggcctcacagatgaggagcgacgaaagaaggagtttgaggagggaggagggctccccgagcagcctagcgaccccgatttcaccaacatgaccggtgtttcgcccgagattattggccgacaggccaccatcaacattggtactattggtcatgttgctcacggaaagtccactgtggtcaaggccatctctggagtgcagactgtgcgattcaagaacgagctggagcgaaacattaccatccgactgggatacgccaacgccaagatctaccgatgcgaaaacaaggactgcaagcgacccggcaactacagatcgttccgatcggaccgagaaatccaccccaagtgtgagcagcccggctgtgacggccgaatggagctgttgcgacacgtgtcttttgttgactgtcccggtcacgacattcttatgtccaccatgttgtccggtgctgccgtcatggacgccgcccttctgctggttgccggaaacgagccctgtccccagccccagacctctgagcatctggccgccatcgagatcatgaagctgcgacacgttattattctgcagaacaaggtcgacctgatgcgagaggatgctgctttggagcacgagcgatccatctcgcggttcgtcaagggaaccgccgccgcagacgctcccatcgtccccatttccgctcagctcaagtacaacattgatgccgttaacgagttcattgtcaaccgggttcccgttcccgtgcgagactttgctgcctctccccgtctcattgtcattcgatctttcgacgttaaccggcccggagccgagatcgacgagctcaagggaggtgttgctggaggatccattctcaacggtgtcctgcgactcggagacgagattgagattcgacctggtattgtcgagaagcaaaacaacggccagttcaagtgcaaggtcatccgatcccgagtccagaccctgtttgccgagaacaatgacctcaagttcgccgtgcccggtggccttatcggtgtcggaactcaggtcgaccccaccctctgccgagccgatcgactggtcggtcacgttctgggacacaaaaacgctcttcccgagatctacatcgagctggaaatcaactacttcctgctgcgacgacttctgggtgtcaagaccgaggacaagaagctcaccaaggtcggaaagctggcgcgaggcgaggttctcatggtcaacattggttccaccactactggagcccgtgtcatgaacgtcaaggccgatatggccaagctggtgctcaccacccccgcatgcactgagctcggcgaaaagattgctctgtcccgacgagtcgagaagcactggcgacttatcggatggggttccatcaaggagggttccaccattccccccagcgagttttaaaaggtatagattaacgattggagattgacgatacaaggatccgagtaaggaatgagcgactgttatgcttaacgtacgctgtgtagcgatacagtaagaccgaagctgtagatgtatccgaagcactagtggtatgtactgtagtgtactggactgatacttgtacatactgcacaccttgctgtactgaaacgcgatagataacaccaagtattgattatatgaagagctacttgcccgtcttcgttggttctcttgcaatctgaggcaaactaagtacaagacctctactgtagacagcctctgaggtctcactgtatctactgattcacgccgacacagggcaaatctggtaagcgagaaatattagtatcaaaaagatcagacagacttgaaattacactgtagtgcgctttcatcaaacatcagtatttttctcagcttgaatcctttaattgcttctcctccctctggttgtgttctgaaaggggagggcatcggtagacagaaatggcgacgcataattgatccattctagctgttggtaaatcaatcaaaaagtattgaagggtcctcacagttcccttttagtcctgtcaatcaacactaaccctcaaacaaatatgaaggtcttcttactctactccgccggctccccgccgttgacgaacccagcttcttggttgctgaaaacgagctttgactccgaaagttgctactggactatagccatactcttgttaccactcttccaagccaaccctgttattgaaaaggaagttgttggtgttgataatgccgtcggacatgaatcccatctaataatggtgcacatacaatctatctgcctgtatatataataatttaatcaataaatacatgtatcaggcctttgtaaccagaggatactttctaggccgacctcgaggacgtctaacgccgccctggtatcgccggtctcgacgtctggaccttgatttcgtggttctttggggagcggctttctccactgtggtggtcattcgaggaatggggtaggctgtctcaaacttggagtagtctgttgtggactcagcctcggaatcgacatcgtcagcgccagcatcactctcgctgtcatcatccttcttgtccccttcgagtttctgctcctcctcttcgaccccatcaccgtccttgtcatccacttcgacgatcctcattccaggctccaagtcctctctagtaggaacctttgtgaacggccactccggcaccggagcccaaatcagctttgatggctccaactgcacatagttgtttgccttgtacttgttgacgaccatatcgatggcctcccaattcaagcgaatggcatacttgcctgtctcagggtttctgaccagaaattcgagtgactcaagagcagaaatgacgtcgtcaggtgtcatgccggtggatttggtgatgtccatgacggagaagtttgggatggttttcttgtcggccgccttttcgcgagcattgaaaaagaaccggcagatcatcagccgccagtactttctgtagctcagcaagcccaggtcactgaggggtttttcaggcgtgcctgggcgaccttcgactcgactcagcaggtacgaaaagtcaatcagcagctgtccgtatccctttcgttggaaaatggggagagtcaaaatgcaggacacgttgttggtgcctgtggttttgtagggttgttgtttttccttggagaaatagccgacgaaatggcatccgaacgcgtcattttcggtcagaacgtagaacatgaagggctccacgtcgtagtaaagcgttttcgagttgagaaacattttggccaacagacacaggttctgacagtatagctgggcacgcgcaccatcaacttcccagatggaaatgttgccgtggcgatatatttctgttccgggagggtgacgggctgcacactttagtttgtggcgtttgcgcacgtgtccggaagacatgtacttgagacagaactcgcacagcggtagcaccttgtttcgggcgtattcttctgggtatggcgctgtatgccaagtgttgatttcgtagtcgccaaagtggatgcatgtaatgttggcgttcttggtggttcccagcgacgcatctcctcgggaagaccgtttggactcggccaggctgagagtctttgagaagagtgcaatgtcgtcggcgttggggttggtttctgctgtcgatgcgtcctcgcccactagagctcctctgtagggaggctccgtttcaatcggtgtgctaggcgatgaggagtagtccgagttgatgggcgatggcgatcgtcgtggcgatggaccgggagacgtggacgaatcgggcgactcgattaaccgggggacgttgcttgtggcgcgtcgttcgcgttcacggcctctgtctcggatctgcgcgcttctagaccgggtttcgcgcgtgtttcgcggccgtcgcaccctcactctcagaccatagtcgtcactgtcgtcgccactgtcggtgctgtagctgtcgctggagttggagttgcgtctgggcactgggatgcgcagcttgaccgggctgcgtctcggagacgccgatgccgctggaggagtgcattttcgggggctgcttttggggcggttgcgtcttcggggctcgatgatgggctgaggaacacccgtgacagttttgcgcggccgcccgacctgccgcttgataggccggttgtacttgatagtcaagttgaacgacgttggcgtcgcttcccacgtcacagacatgttatgatgatctagcagtgaaatgtcgtgagaagttgttttggacttgcattgtggaggtggcgcctaaagtttaatttccacgtttcgctactcaaatctgagccgcacggagggagtgtcaaacggcggaactttgcaacactcaaacaactcatcgtgggaacaataaacgccgggtaagaagtgacagaatcgcaatggttcacacgtgtaataagtccccaaagtatcaatccttcagatgtgttatatcctttcgacatgaacattctggtaaaacacgctaaatagaccctccatatggatcaatagaaatcaaactccaacaaaaagcccaaactttcaagagacggtcaaatacaagtacttgtacttgtacacacatcaaccaatactatacattaatgacatccttctatatacccctacgtgctatgggcgtccaacttggcccggttgaccagccccaccacacttcgtcgagtgtcacccgtgtccaaaaccttgagagccgcatcgaactcgctcaatagatcggaatcgaggttggtccggaaccgttcctcagaagccaaggtggccgagttgggcttgtgcaagttttcaaagttgggcacctggagaggactgttttgctgaccaatcagtccagtgtcaaacgcgtacttgagaagctggaaaagaggagtgtcaaggagaagagcctcctgttcctgatctgtccggtctgacttgtcgagaacctccatccagtccgtttcaagaagaacccgaacccacacagtgaggctcatgatgctggtctttgcgttattgctgtcagaaatggcctgcagagcttcttctgagaatccaatcacacagctgcacagttcaacgagctccaggctggtcagcaccttcttctgaaccaccttggtcaccagcttcttagcggcatcagtcacaccctttggaagttgggggctgagaatctgctcactgaaaatctgggtgccctgcacgtggccagagatgtgttcagcaagccgtttctggatcaaactgagattgagctcattgttcacctcggtctgctcacgcgaaggatccattctggtgccagatcgagcttgcatgaatgcaagcttggccatactgagctgcacaagccggtttcggaggtcccctcctggaatggtatcttggccttccttggccgcctggacaagagcctcggctgccgactggtattctcccaagccaagggagagaatccacgaaatgttggcgtggttactggaccggaaatattgcttcagcatttcccgatagtcctgaaaccgggtgaacaggctctcaaagtcgcgggtctcaatccagtacgagtaaagctgcgaagcaaagtcgtagccaaagttatgcaggtactttcgaatggcgtattccgcgtcgctctcgctctgcttattgttgttggtgatagccactcgcagatcgtggtcgagaatctcggccaaacatcggtacagacggaacgtctcacagatatgcagcgcctggctcacttgacccaccgaaacgactgccttaatccagtctccacgtcgctggtggtatgtgttttcgtatgcctgccagtcgttgcctgaatttcgggcccaggtgatagccacgacagattggctacacagagactgggctaggggacccagtggtctgtgatcgttcgtgttgttggcgatgaaccggaacagtgagtcccaagtctccatcatacgagattcacaccaccaagggcaattctcgccagtgtcgtcgttggaaacacgcaaagcagaaagagactcctctcgtgcagtgagaatggcgctaattgcagaccccacagtagcagcgaagatggagcccatgttgggctgctgaatattgtcgaacacgccgtagatcaggttggcagcctcaagggtgcggctggtaaaaaaatcctgcacggggtcctggtccgtgttctggttcttgtcaacactcttgacaatgatgttttccagcacaatgtagccgtccttgacgtccagcatagcccagatggcctcgcaagccgcgagtttctcggcattggacgccagagttagctttgtagcaacgtcgagctgggacgcgaagttgtcgtaggcgtactggttcaggattcgcagccggtccactcggaattccaaactgaagcccagtccagggaatcggccctccagatgggacgatgtagacgtgcagatttcatgcgacacctgcaacagtgcacgtcggacaacgtcatcggggaacttgacatcatactctccagtggcagcaaactgcagaggcgtaaagtcgccaccggcaaaaaacacgccctgctcgattcgtgacttgcagatgccacgctcgagcgtgttcaagcttctagtttgctccttgtcgtcctgttcggggaaccgggtgattttcagcacgccggccgcgtctgtgatggccacaatggcggagtcacgacttcggttcttgtcttcggctccaaagcctagaatcgacacagtgggtttcagcaaaatcgaatcctcccacttgccgtactccacaaagttgaggttagatcgcgtgaccatgtcgatgagcaccacggcatggtccagaaccacatagagcgtatcgcctggagagggtcgagctagtctaggagtgcccctgtccagtcctggtctaacgtacgactgcactctgtgacgactgacaaccttgtctttgtggagatcgatggtgtagatgatgtagaagatggaattgtcgacgagaatggaagtcagcaccacgagataatcctcctcggcaacgtattcaatgtcatgcaggtagatagacgaagtgttgtagagagtagacacgtcagccgaaagcatgggcttcaggtccttgtctgccaaaatggtggcatctccaccctctgtcacctcccacactccaagatggcactccgaggtggctacgtagatgcgccagctgcggttcgtagagggaaccactcggactccagtgattccacgtctgttggaagacacggaaaaggcggatcgaatgttgctcaacaggccggcctttgtgtctcgcagagtccagtagttgagagcagcctcgtccttatctcgaagagagaggccaatgagacggcccgaggacagagacagcaccagcgtgacatcgtccatgcggttcacgtgctcaatcacctcaccactgtatagcttaatctgggtctccacctgctgtcgtgttcgcaggtacccttcagcagctgcacctcccactgactcccagaagacacacaaaccagaattgacacccactagcaccagaccgggatgtccaacgtccttgaaactcggcgtcacggggatcaggtgacccagagcattatcctggactcccagactatgtgtaaaggtctctggggtcggctcaggagatgtgtacttccacacatgtgccttgttccccacaaccaccagcccaaagtcgtcagatagcgatgagctcacatgctcaccggaatcaaaagcaatctccactcctgatagatcgggtcttgctgccaatcgcgtcacattgtacatggccgtgcgggtgatttcggagccataatccgccagactgtcctccacagccgacaggttggtgaacgacttttccgtcacatcgtcgttgaagagcgtcgcaggcacaactcggttgagttcttgctgcaccgctttttgccgcagctttcgaatattgccaatttgcgacatggatggatgtgtctgtgtttgtgtttggatctttttgtgcaactctcaattgcctgcattagggttagggtctaccaggaggtggattatgttgtggaatgatggttgtcgtaattgcacaaagaaccaactacaatggacttttaaacccttgatagtgccgtcacggcgactcctgttattgttttgtgtctttggacgctctattgtctcgttcttcttgcaaatactaccctaagtaaaataccaactaatacgaggttcacaacaaaggattaacaaaattgacacaacctacgggccaactaatagtcaagtaggccctcaacaacattctcgctctttctgaaaccaacaacatcaactgggaaccaggaaagtaaagatatagctatatatcagttattaactcgtcaattaatacgaccagattggattatacattttactatcgtatgtgattgtaacatcaccatcattcttaacaaaatcctcaacccttttcaatcaagttggtggttgatagaaactaaagctgtaatagatactatacccaactcataccttcatctcatatacatatgctcgctacaaattatttctcccaatcctcttgtttgccactcacaatagtggcgatgattagtaaactgatctcagtaggttttcaatagtaagacacccaaaagtagccattgacgtacgaaaagtgtgcgtgtttttttgaaaattaggtgtcacatgaccataataatcacttttcatatcacgtgaccaaatcatctcgcacagtcgtccaaacacctccgtctactgacatttctactactccatcttatcagggtaagggcaaccgtaactgtaaaaaatttatgcaggcggtgaaattttcgcctacgcagacattacaccgaaccacagttacaggtacagcaagaaaatatgttgcgacaagtgaaaccgaaaaacgctcgggccaagcgagccgtcgatgccaaggagcccaagattgtcgagaacacaaagcaggcgctgtttgtgcccggccagacctccaaccagcttcttcacgatgccatggtggatctttgtgctctcaagctgcccgatggcaagcgattcaacaagaagaacgaaatcaacccctttgaggatgtgtcctcgttggaattcttctcggaaaaaaacgacacatctctgctggtcttttcgtcgtctaacaagaagcgacccaacaacctgacctggatccgaacgtttggataccagctcttcgacatgatcgagctgcagattgtcaaccaccgactgttacgagatttcaaggcccagactgtgggtgtgggtctcaagcccatgtttaccttcaacggtaccggctttgaaaccgaccctgttctgatgcatgtcaagtctctgtttctggacttcttccgaggcgataccaccgatctgcaggatgctgccggtctgcaatatatcatttcaatctctgccggcgaggtgcaggaagacaagcctctgcctctgatcaacttccgagtttacaagatccgatctttccgatctggccagaagcttcctcgaatcgagctgcaagaaatcggcccccgattcgacttcaagattggccgacgacaggctgctgctcctgacgtggagaaggaggctctgcgagtgcctgagcagctgcgacagaagaccaagaagaacgtggaggtggacaacatgggtgacaagattggccgagtccacgtgggtaagcaggatctgggcaagctgcagacccgtaagatgaagggtctcaagaagaagtacgaccaggtcgaggacgacgaggaagccgatgacgaggtggtcaccaccaagaaggcccgagtggaagaggaggagtattttaatgagtaattgatagaatgcattttaatgataaccgtttgtgtagccacgtgaacaaactccaaattttttcatcaaacaaaagagattgcgtattccgttcgattcatcaagggtagatatctatttaatttttagtattagtattatattagattgtttcgtatgtcacgataccagaaaacattctgaaactgtcttccatgtggtttttatcgaactgatgtcaaaaggagaaaaaacgaccagtagagtcgtcttccaaccaaccacggcgtcaataaaaagtgatttatagatggatatgtatctttttaaatgaattgagatgttctcagacaagtataaatacacggcaagtgcagtattacctgaacataattacaaaagatcaagcgtctacaactacaaactctctacgactcaaatattcgggtgggactctttggtccatgatttattacccaagaggttcggattttcacctactcctctcaaactagataaacaggttcggtcagttacgtcctccggctaagaggttcaccgcctactccttgaatagtgtatgactttggctcgtgctctggctctcactgctctttggacttattggcaactggctggcctcagctctatggccctggctctcccggctctgtctgtctgtgctctggcgtttggcgcttattgcatctgtggactcactggctcttgctcaggcgaaaggctcttattgccgttcaggactcactggctttggtgttcactctcattcggcgtttggcacttattgccttgtaggacttactggctctttgctcgcaatggtaatggctctggctcaatagccgtggctctggccttggcacttattgctctccggacttactggctctggtaaatgctcttattgctcgttggacttagtggctatgctcttcggcggctctggctacgcttcgactctggcatttcagctctggtgaccaacgtgacagctctggcacttgtgtggctctggttggcactcattgcccctgtgggtcttattggctctgactcaggcatctgttgctcttttgaccatatatggcgtctgtcaaagcagatctttgctctagtaatgcgtctcagctcagcgtctcagctggctcctcagcgactggcagctctggcatttcagcttggctcttcagttctaggcggctctctcacaggagtttcacctgtgagaatgatgggagtctatcaaaaggaatttcacccttgagtatctcactgtcggtggctcgcgctcagtggctctagctctttgctctggcggctgcacatgtggtcctcgggaactctcacaaggcacggaggtggctctgacatttttcagccggcacaatcactccctctttgctcatggcactttttcagctcatggcggtcaaccggacacaaaaggttacggacttaagacacttggctcaggcggttgtactcgcttctggattgaactcgccggtttctcagctcaatcgcccaaacagaagctctcgcactaggctcatgcgataaacgcgtcattgccttcttaaccgacactggggttctggaatctcaccacattgccccaaacaactcaaacggacgacaaaaaaatgaaaacgtcctcgttgtagacagatccatgttagctgtcttacgagacaggtctgcttatcagctctgcatcgcagcaggctataaaaggcaccttccgtctccagaacgactcagagtgaactggtctgattctggtgtaaaaagtgggacgcagaaggggtttatgtattcctggtcgagactgtttaggtttggagaggtcggtcagtggcgaaaaaatgtgcatcattcatgcgtgaaatatgccgaccagccattaaaatgcaggagaaagaaaaagacagaatcacatggaaagctccagaatgagatggtagagatattttgaaataattatggaaaggatggcatattcgggtagcaaaacaatgatttcatcctttcaaatagtgtcatatcaattttcctgctacttcgtagaccccagacatgacattcccttgaatatcctaaaaccctatgcaccagccctcttcctatgcaaaaaaaaaacaaaaaaaccagagaagaatagcggagaatattctatgatacccacgctgcctgaaacttgatttcggaagagaccagtcctggatggaagtatgtaccaaaatccctcaacaaaacgtcttcttgttcccaaatagctgttttttgcccgtgggagttctgaatgcacacatgtcgaggaggctcgaatggatgacttatatgtgaacttgtgcaactggataatgggaaaacctgattgattcaaatgtaagagccctgttatcaaacagtaatgtacttatacccctgcttctccctgatctaaaaatgacatcgtagaagctatcacaccgacacaacgactaagactaaaatggagatcatgggttggaaacggaacatgaaggtggcaaaaagaggtacagtactgtactacctcattgaaaataagccaaaaaataattgcagcacctaggattctcgtatggtctcccactacaatactaactgggctctctggtgcttgactatggctgatcggacgggaagccgtattttcaccaggatatggccgcaactaacaaaattaatgtgagaacccatttaactggcttaacaggttatgttaccggcaaaaacaccaaaataatctaggatgtctgttgtgcaatatctggcagaagattttctcttgcatcaaagaaacgaggatctgaatctgcctgatcccaccaaggataagagtctgcaagattcttaatacactctgatgagtttcatggactgtctcgcttcattgctggcactttataagtccatgggtcatgtagcgacatcaccttgctaacgctcgcagctgctgtattgtacagatggtactgaagatcatgatgacattaccatagagcatcttgatatattgctagatatcattcattatagacacagtatgtacattatgtactgtacttcaacttcatgtacttgtagagtaattttttacccatgatactatttaaacatatcagtacaataccaaaaatctcacaccaacccaatacctcatccacacaactacactcttacgaacagcccaagaccccaccgactcatctgctttcaatcacaccttccaccacccaccacccctgtagagtcgacaccaacgtataagagcaccttacacaagaagtggttatctgctcctgagaattataggcaaggcatggctctacctgacaaggaccgctggttgctggcgatggacgaggaaatgggtttcacaggagcaacgaggtatttgagtgggtagacagcaataaaatcaagggcaagagagtattctggttttctctctgtggaggtataaatgacacgatctgagggtactgtactaagactgacaagtggctaactgaactctatagagactggaaccaactcgctgatttcctcacgaagcaacttgtttggactattcctcttaatcctactctcctgaagattgggataatgcaaatactggacgtcgttgacactctcaacgaaccggtctagggtattgatcataagtataattgattggatatctttaatgaaacgacgtacaagtataactcacctctacggacaccacgttacgatacacaccaagggcgtgtgcttgctcattcaccagaaagaggtctagatgagcagatccactatcagatacactatcagatacaccatcagatgtcaggtccaccatcagatacaaaatctacaggatggacatctcgtctacgccaagttgatccctcatgactgaggaattgcctaggtataatccctactgttggagattgttcagcgaggggcacgagtatcagcgtgcaataccatcgacatcggagagtctctggtgatcacgtacaccgacaattcaattcaatagtagttttgtcgagactgtgtcgtgccacggaaagaattcgtttttacaatactggaatgcgataacttctcgctgagtcgccacattaccgcgtagccaaacgcgctaaaaaatcaattagggagacaagataaccttctgaacctcaattagagaaaattgaaggtaaaagtacaagtgatgtatttactttagttatactgttgagtgatgttatatataaaaaagaatggtaaaacttgacaggagacaatccactactgtactagtagtttccgttctgagggacggattcactcagcagaatttgtcagcagaatttgtcgcctgaatttgtcagcagaagttgtaacctgatggcagactcagtcgaatcctccactgaatgcagagactctcctggtgtctctctgatagagaaaagagtctggtgtatcggaacgcgtcccagcatgatatgtaagaggacacactgcaagtcgttaatgtatttgttatataaagttcattttattccacatttaggaaattcttagagtatatttgttatatatatatttttatataccatatcccaaattattgcaccactaaacaccactacaaatacaagtagtgtattgagtgaaggaacaagttttgttgagaagatgaaatggaattcgctatgatgaaaaaaacaaaaaagggagaccatccgactgtacaagtagttgtagccgtacaggttagggtggcctcactattcattctgttctggtactcagtcccaaaccataactgtataattactattattgcaatgctggacaaccgacgcgtcttaatatttcacagccaaatattacacagcacgccaaaaactcagagatgaatgactcgctaagttctaaccggaaacgaagcgccagtcccggtcgtgaatctgagcgacagcaacgtccacgccaagatggaggagctgacaagacggccgtggcccaggagtgtcactgcacacctaagacgtggtggcagggatggacacgcgatgatgtccagacatttgtttgctgttaccagaaggaaatgcagggggtgaaagaggccaaccccgggttggacagagatgctctcttcaatcttcaaaatcaggaattaatgcgactggtcaaacgcgacgtggttggccattacaagaagctcatgatgtccaaggtgaagaagcagaagcccaaggaggagaaggtgaggaaaaaatccgaagcgccacacccaacgacgacaggacagcaaatgacgaagacacagcaagcggcaaggcaactgacacccagtggaatggagactcagttgccattgagtcctgaaagcagcagcaactgcagctacaaagagacggactgttctgacagtcctgattctccagtcactctcacagatgaacagcaggcgattttcgacaaggtcaaggagggccaaagtctcatgtttactggcccggctggcaccggcaagtctatgctcattaaagaaattaagaaatggtgcagcagaaacaagatcaactgtgcactcactgcgcccactggtctggcggccatgaacatcaatgggcaaacaatctacagatgggctggtctaggcctgatgaagaacaatctactcgattccctacagaatctcacaaaaaacagaatggccatctacaactggtacgaaacggatctactcatcattgacgaagcaagtcagatatctgcatctacgttcgacaagattgacacaattgctcgtcatattagagcggaccgtagtaaatttgcagaaggaggttcttgggcaaagaactttgcccctcaagggtacaaagagaacaatgctccgtgcggaaaagacctgatggatgttccatttggaggcatgcaggtcgtctgtgttggcgatttctttcagatagcacccatctgtgatcgcgtaaagcaacccgagggcaattcatcaaagcaggtggctgacactaacaagaacaagaacaagaaacgagtcaagggacctgactatattttcaagtcggcagctttccaggagctctttgagtacaataagttctgtctcacagtttccaagcgtcaagaacagggatccgagttctccaacatgcttgaagcgctcagaaagtactctggtgatagagcagatggcgcaatcataaaaaagtactttgatcagtttgtgggctcccacgacggaaaggaggctgtctatttaactggaacaaacaagaaagtttcagcgatcaacgccgacaacttggatcgcttggctggccccgaggtggcgtttattgcctatgattatcggaataagaaatatggtaaatccgaaatcgacgcccttttcaagaaaaaaatccgtgcggaggacgtcattatgctgaagccgggtgcacagattatttttctgaagaataatccacatctgggacttgtgaacggtcatcttggccgggtggcatttttaatggccatgtccctttaccaaaagtatcactacgatttcgacgtcctttatcctctctacaattactttagaggaactaacattgacattaaaactttggacaatgaacctcctaaggatatcgagaaggtcattggcattacattccaacatccatggtgttactaccgagacgccctggtagcgattgatggttcttataaaacagaggctcatgcccaaaagcagaactacgacggaatgacaataattcctgccaatcctagtctcaacacctgcttagaggttgttatcaaagtgggagacaatcaaggaccgcagagcaacaaattcttcctagtgagtacgaatgagtttgaggaactcgactacagtaagcccaactcaagcaagcgcaagttcgagattgcggcagaacggaaataccccgtgatatgtcgacgtacacagctgccattgtccttgtcatgggcactgactattcacaaagcccaaggtcagacgctccgacggacgatggtggacatggagagcatcgatagtggacagacttatgttgctctctcccgggttagggctccagaagacttgcggttggtttctttcaagctgcccctcaagctcaccgatgtttcagtacatgaattcgataagaccctcaagaatgtcttggagtgatgtgatataggtattgcaatgtatatcaggtacaaaatgtgattgggcgtacattacagtagtttctgacttgtacggacacaccgatggacacataaaaatgaatacctgcttgatctcatcggatcttactaaaattgcatcactacagcgactctctcgattattacaaatccgctacactcgtagcgagttttacgttgccacacacaacaaatcacgccacattctgcttcttggctgaagactggttctccttgccagtagccttgtgcttgacaactcgaggcttcttggatgtctcagcaatctcatacgagaacacatcttagtgtctttccctgtccactaacgggtatcttggccaaacccgcatacaaaattctccaatgagggtagaagtcatcaggagataacatttgccagttgtgtgatgcaacccatgaacacagggatatatgaatacaggaatgtccacatgagtgcttgtccccccaaggcaaccatatccttcacgccggctgaaaaggccgtaactactcgggacgggatatcggtgcattaactggtgtagtcactgtcatttctacagctgtcatgaaagggactctgtaaaatggcttagaacgaacagcaagtgtgattggtttgcgttaagggccgacggtgttctgagagtagaagctggatgagacggggcagagggtccggacagagctctgataaagccaccagccatgacaaaaccaatgcgagtaacagttcacgatcccaacaccgtctcaggcccagacgattcaccgagtccacacgaaccacgtgtttgggtacccagacagcactgtcccaatcacatggatggtcgttggtatggcggcggtaatctccatgcttgcagatctgaactggaaatatgcccgggtttggaggttcggagctgggatatatggcataagtcctctcataaccgaacagggatgtatgacataagcccactcaggttacagtttatgttgctggaggcaacatcagacatgacaatatcaacctgctcagtgtcgccggaatcagcgaaaccaggttacagagaatgtagttagattgtgcaattgccattcctttttgttgaagaaatcatcaaaaaaaaggtgtcaggtttgtcgatgggtggtggactatgtgagttcttagtgaattcttggactgaccatccatacttggcttggtactgcttgcgggcctctgtaaaggctgagaagttgtattaaatcttctgtataagcccagcaatattttgaagtagtttctgttttatatttttgttcattgtacactcaaaatttgagcacttccatcgactttgccccttcatgttcctacagaggaagaatgaggtcctacacatggattaacaagaggaatatctgcgtcaagttgacatcatacgttgtaaatttgttacttggtagacttgcattcatctggtcgtttgtatctcatggtttccgtatatggcccagcaggttattatttaatgtttagggggtcagacttcccctgcatcgatactgcagagagacaaggcgacctacaatattcggacggttcggcgcataatctatgcaagagtctttttttttgtaataacacaatacattaaaatatagaatatgagaagattacctgatgactcatgataagaagaatccaaaaggtagatgcaggtactgtagtgtctgtactggtacaaggctgcacggttgggagaagcacatccgaatcttttgaatctttccttaacaggtataattccgattcctaccaatcacgggtgaagacgatagtcactaccgttactacttttgatgtttttaggggacgctcgagacgtagctgtcacctgtgtgattaacccgtcagaatcaacaccaagtagaatcatgagaggggttggggaagactcccggtgtctgttatgtcttcgctgttcgctttgctgtctcttcgattactacgacaatgtcctctttgcagttggctgcgctgtcacttcggtcactatgacactgtcgccgcccatcggggtgtccgacgcgtaccagtgggctattggacaaccttggccagtgttgagagctgccctgtgacaggtggaatcgttctggtgtcgtctagaaggtatgaagctcgtatgaagctcgttggtatcacttgtactgtctgtgagaacaccatccatgtacctgccctttacgccagtggtacactgtaacccttcttttgtcagtgatcttttaaaaaacgacgtaattgatgaacggaaatatcaaagataacacttgcattttacaatttttgtactattttttgtttcttatacaaagtgacccttatatcacatgtttatttgtcctcgcacgcatggaaaaatggcccagtcctgaaatctgtaggattttcatataacttgatttatatcttcacaattcgatttacacgagctacttaggatctggttccactgtagggattggaatcctcttaactaattacagaagttgagtctgattcgtcttaataggttctttttggatttgagctgcaaatgttcctcctacggaccatcccttgcgcgtgtcgtgctgaacaactacacatgaagttacttgttcttgtacagtatctactcgtacttataattgcgcacccgcgacccactccagctaaacagcagcatctcgacccttgtcaagcttgccgactccacctaatcctgaggttgactctatatgcgtttttgttgctttcggtgaagagctttgctactcagctttagctgatgacggtcgcgatgttatggaattggaggttgagtgtggctgacatcctccactccgtcaatgacgttggcgaaccgcgcactcaacctcacacgttcagccgtgctatgatggaggcctaatgagaatgtgtctgacgacgagccgactccgcaggaactccagcctttgtgaggggatccttcttatccgatgaagctgtaagggagagtgaggattcatcaccaaccagccttgggcgatacctgctggaaagtgcagtctgagtgctcaaaagatatgtgtgctgactgataatctgcaaagagaatggaaacgttttcataatatatcgatcaagacagccgttggaaaatctacacgaaggagaaaacacagagtactgctccaagttttcgtcttgttgcaaacgagaagcacccaacagtcctactgtgtgaccatccattgctcagcgccccaaccgttggtctcaagtgatcataatgtttgtataccgttgttcaaaacgaccctaggccaacgtgcttgactttgagaaggagaatactcggctgtgcctttcaaagcgccagactcaagggacaagtacctcggtatattccgcattttaatctcacgcccaaaactcttcatctttagcgagaagcagctgctacatactgcttgtacttgatgaaggtgtatcaaacccaaggggatgagctatttttggcgtagctccatatgcagttactacgactgcgggctgagtgagtaccagtatttggagacaggtctcgccatctcaactgggatgagaagaaccaggagttcggatattcgatgtacacgactcagatcattgccgatgtaatgaagatgatgagactgacgcttgtgtatacagtcatcagacgtcagcaacttggaaaagtgcttccagtgatgggttgccagtgaagaacgcaggaagatgtttgccatgaaaatgtcgagtgtttctccgcatcaggccaccattgtatgacccacgtacgtcagccagcgatattatggagctgttgacattcgcacatgggatcagcacgtgatcgtcggccacaatacagtgtgagatatccgaagacgttcgtatttttgtacaatgtccttattctgtgcgctgttaactaagacaggcctgacaactggagcatatccggtctgaagtcaattatccactgacaaggcttcaaatcgttcgttgtaagccgtgactgtatgcagagaaagggcagtcttcagatacttgctgtgagcaagaccaggacatgggctggtaacctacccgaagttgaagcagccactctcggagcgggtccgaaaatctgtggggatgtaggacggacagaatgggggtcgtcgtacagctgctctccgcaattgaatacgaggttgtggagagagtggaaaggaaatggaatggaatagatggatatctactgtacagatctgagagagcctgcaaaacagcaaatcacgaccacatctcaccgtgcgtttcgcagggccgtccgcagggccgttcaagtttcttttctgctgcacattcgatctcaacacacggcaccgtgtggctgccaacatgccactcaagtattcgtcatagaagccacgagtttgagagccggatttgaattgggaacggttcgaagagaatttgtcggatatacatgtaccaccttgtccaggtcctgtattgtacaaacacactgacagactcatctacagtcacctcaacgacagtatggacacgacaaaatacacggagacggaacttacctttctgtttccccacgatatctcgctaatagcgacccatgactggctcaaagaaaagcaaacattactctgccctaggttagagggtaggttcaaccaggggctactggtagacaggagataagacaaaacggcgtgcacgtggggacagaagctgaggttcgattgagccggtacaagtacacacaggtttatctggaaaaacaagacagctcatctcttggctccggggtagacacatgtacaggcttggcattcgggtggaatctgggaccgggggaggctgttgtcttgtctcttatcttggcctgtcttggcgacgcacctctcgcctttgtctcggactcttggcgttgcttggcgccggacttgttccccccatttcttcctccgtatggtttcatcaccgaacaccacctttagccacacaaccttccagccatcaagattcgcttccagctcagatcacgcaacacatgcatgataggcactgtggcaggggaaggcacgaaaaagacgtgcatgctggacattcgggagcgcacagttcccgtactgtactgtacatttgtgaggctgtctcgcttactaatactgatggtgtgtgacgcaagagagaggatctccgaaactggcttatcttcggcacgtcatttagcgtgcttttaaatcatcggtacaccagtcttatcagaattttttggagttacggtatttaggatttataaaaggtcagtatgtccaaagtaagttcctttctcgtgagtatgataacgtcttaccacggctgtagccactgcaggtacagctataggggagtgtagtcgttcacggtctttctggcggacagacaacccaaccagtacgagttgaggacgatttggagacaagaaatccaggtgaagaacccgatttcggaacttgggccccttgcccggtttcctaggcgtggcttgtctccacagttccacaggagcactctaagctcagacttcacaaaggtggaggatacgagatggaggcaattgtcttttgtcttcatccaatcaatgtggtttgattaatactgttgtttggatgttggggtttggttgcgtaggagtctactgagatggagatttggtcaacagtcagtcatagggacgatgaacaggaccatgtgttcattttctcgaatcgtgcacttccataaatatcccaggcacgctgatcaaactcactcatgctcaaactcgcaaccctgcttctctgtcccaccaacctactctgcaagcgatacctcatctcatggcacggcaccaactttcccaatgtctgttgaaagtccgtttgagagatttgtgcacttctgatgcgaggggtcaatacttatacctgagcaagtcgtctgttttctaactaccactccaaaaccaatgaagaagttcacggagtttgtgcctgagggctgggttcccaccttccacaacgagccgcccaaaaatacagagaaagatgaagttgatcggtttcttgccgaggcagtggagcctgatctgctcgacatcataggcaacaagttgaatgctgccgtggaccaggacaagggatacgacaaaaatgtgcggtacattgcccagcgtgtgggtgaaatgacagatgaagaggctcgatctattctaaaagctttctacacagtccatttcgacgacggaaatctcagctcagagtacaaagatcacatcactgaacttgccaagggatatcccgggatgggaggagacccccctggacctcgagaccctgagatcccttacgacgacgataaagacgaggctcctgaagactactcgcttgaagtgcggttccaagcctcacttgtcaagtactggagtccctatgttgaggtgcgagccgtcactgacgcctacgacgaccccaacgaaccctgcgaaaccattcgttcgtactttgtgggtttcatctggatggtgatcggagcaggcgttaaccagttctttgccttccgcttcccctccatttctctaccgtccaacattctgcagctgctgtcttatccttctggaaagctgctggagttcattctgcccgactggggtttcactttcagaggccatcgaatctctctgaaccccggtccctggtctcgtaaggaacaaatgtttgccacctttttcatctccggaggtggaactccttacattaccaccgcaaacattcctgtccagctgcttcccatgttctaccacgagacctgggcaacctttggttatcaaacgattctcactctctccaaccagcttatcggaatgggacttacaggtatgctgcgacgattcgccatctaccctgccaaagcaatgtggcccatgagcatgcccaccattgctcttaaccgagctcttcttcagccaaagcgaaaagaacgtatcaacggatggaccatttctgcctacttgtttttcttcgccagcttctgcttcatgttcatctacttctggttccccaattacattttccaggcccttagtaccttcaactggatgacctggatcgcccccaacaacaagaacctggccttcatcactggctctcagaacatgggaataaaccccttccctacttttgactggaacgtcattaccggtggagcaggtgatcctctggttgttccttggtcgactctgctcaatgtgtactttggcgtttggatcggtacctttgccattatcggtgtattcttcaacaatgtcagaaatactgcctaccttgccatgaaccagcctggtatctacgacaacaccggaagttcctataacgtctccttgattctgaactccgcaggacgatttgtcgaggagaagtaccaggcgtactccccgcccttctggaccgccggcagtctggtgtcttatggagccttcttcaccgtctacaccctcggtatctcctactgcttgctgcagtatcgacgagacatctggtctgccatgaaagatcttgcacgaggagttcagttctggagaaaggacgagttcagaaacactcatcacgacaacacctttgttcggtccatgaacaactacaaggacgcgcctgagtggtggttcattgctctgctgctcgtctccttcggactggcagtggctactgttgagcactggcccaccaacacgcctgtctggggtattgtatttgtgcttggtttgaactacgtctttctgattcccattaccatgatctccgcctacactggaagcacctggtccatgaacgtgctggttgaaatcattatcggtgtggccctcaagggtagaccccaggccctgaacattctcaaggcctatggtgtcatgattgactctgaagcttcgggtatggcttctgtctggaaaatcggtctgtacacttatgttccttctcgggccgtgttccgatctcagattatttccgccgttctcgccagtttcacctgtctcggtgttctgcaataccagcttcatctccagggtatctgcacccctgctcaacggtttaccaccaagttcacctgtcccggactgcagcagttcttctctgcctcagttctctttggtgccattggaactgaaagattcatgacccatctctaccccttcctcaagtggtgtttccttctgggagcagctcttggacccttcttttggttcattcaaaccggtggacccgaaatgttggccaagtggaagccccagtacgctagaaaatgtgtccagtggtctcgacgagccaacctattcaaccccgtcaacgcctgtgttggtattatttcgtttgcccccggtaacctctgctatttcaccggagcaatttacgtcggtgctctctggagattctgggtccgacgacgatacatcaagtggtgggccaagtacacgtatgttctctctgctggtttcggctgcggtatcgctctctccggcatcattatgttctttgctctctcgtaccgaacgggcacaaccaaggctcctgaaatcgactggtggggaaacaatgcccctgccacaggttttgacggccaggctggtcccagacttgatattcctgccgtgggctactttggccctcctgcacccttcccttaattctttagattctgaccgtcaaccgggttttaatgtgtttaatgagatcaaatgctgtaatagcgagtaaatggcgatggagtatttgtagaagatgacgcttattagtgaatctagttatatgtgacgagcttccggactgtcaagggcacagcgtattcctccgctgacctaaacaaactgttgagtaatcccgaggctgattccttacatgttcgagcaatatcatactaccgcatcagggttagtcagggcgtttgtctgtacaataaataaatgcagtggtattcaatacgacgtctgaaccaaatcacattgtccttgtgtggtgatcatctcataaaagcatcgccatcgtgtggtcatcgccctcaccctcatgtgatatatatatagcttctctacgattatgaccacccctttttccagttctctggatatgactcgtgcaccatagctttctattcggaacgtccatttgtgaaaaagtgaggaaatacaagagcgatgactcatcaataaggaatatccatcatcttttcaaaagtggcaagtccaaatggccagtatttggtctccatgctttctctgcgtgtttttcgagaattcctgctgcctcgtgcaacctctacggaacgagacggaggtctgaggacttcaaaacattgcctaaaatggtaaaacccctgtcaatattgcctgtttggaatccaccgccgcttttattgttcccgctttccgagtggtgtatttttttttttttaatctgagccgcacggttcgggtcatcgcttcctgaactttgtacggaacacgacacttcggaaggactctccagcggtgcttgagaggaggaaaaatcacgtgagtatttttctttttacgcaaaaattgctgtccaagaagaatctccagctttacttccctcaaaactgcctcagtgctcaatatcgatacgctcccgttggggtaaaactgaaagaaaaaaattatgcataaacgatgcaaccagagatgaggcacgaaaaagccaccaaaagtggaggatttgcaattccggggaattgagtgttatttgagacattccagggcgtatggtagagttgatagagtcttgtgtaggtgtaaaacagagctgggtgcatcgagtgttgtcatacaaacccccaagccagaaatttaacagggagttccctcggaatatcgtcctgcccattctccgttaagtttagtcaattgattcggcaagaatgggccgggaatgcggctgggcatgcggctgatacactgtgagaccacttgagttatttctggcgatccgtctggttccggagaggtcggtgaaggctgcaaggccattgataacgtcaaaggagtgcctgaagataacagggtcaacagggattcctctgtcgtctgtaatgagtcaatgttttgagtggtatcgatggtatggatgtgattgttctcaaactcgcaatcattggaacacccacgtatgtagagtatgtacatacaatagttgggctggaatggtactcaggcaaactggacatatggaatagtatccctacctagccaggatatactgcccgcgtgcttctgttgtttaacgagactctgcaaagcatctagaggattcaacctgacaacaacagcaataatcagcccagtgaaccgaaaagaacgaagattccatgattaaagcactgcccgtggaaacccgctagatctggaagtgaagtcaacacgtcctgttttttttatcacatggattttcactatacactctacagtagacttgcccaaggagatagatccatgttggtcgccgtgccgccggatctaagcgaaattataagacctccaaaagcccattttcgcttgatattcatctccgatttcagtctcacacaaatgacgctccatctgaccctgtccaatcttcaagttaatacctgattataaagaacttcaccgggaatcgaactaaggcacccgggtagatcattgagttaatcatacagatttgaagcgagattggatcgcctgtcctcctccaatgtcgaaatgtcgatagtgaacacccccaacgaggttcttggtctgatcctacgggatgattccacctcgctggagtcaattgtcgcactctctcaaacctgccctcttctccgaaacgtgctggagggtctggatggcaccattgtcaaacaaaaggtgttggaccgcataccgtggatggaaattggacagcctgggacccatctagacacttggatgacagcggcgcggcgcattgtcggccgcaaaaggtcatttgtgtctgaaaaccacaagtggatagactccaccgagtactacgacatgctaggacgcatctcgcacaacacagacatcaattatatcgagtctatcgagattgacggcaaaatgcaacctcaggggaggaatctaccgactgatttcaaccccttgtttgttacagagatgcctacaccttgtggtggacttacgggtaaattcatggaggagattgagggtgatgggacccgatttatcgacctgacgacattggaatactccagagcacacccccatccacctccaactgcatcgacttggactggtaacctcagcgcgagcttcaatatggctaacggcgaaagagcggctaggacgccaatgtcaggcatctgcaccatcaacaaaagtggacacagatacaacctgttgcaagagaccgggaggtggatattggtggagattcaagacgactacgaggacccagatgcgcaggagattcggtttcgaaacacaaagtacctgcttgacaaaaagaatatagtgttggaagacggcgagacccgtctctatttcgacacagactccggcgataatgctcgtgtctaccccgacgctcaactcacgtttgttcatcttcttccgggatctattggggctattgtatttcaggacaatggagaaatggtactggtttattacgatgacattgttggggataagggccgtgttctgctaacatttttggactttcaaggacaggagtttgcagaaaggttgcgttcaactcagtacggccaggagggactgcgagaaagaggcacaagacgtcagctggtggtgacttatggaggaatgctgtatttgcatattcgcgaatcattcttggttccgttgtgggttgaactggatgacaaggcttgtcatccccatgacgatcggttctcggagtttgaagcatttgcacacacatcttcaaaggtggtgattggaggtctgcgagcagacatgaagactctgcttttggctccagagcgagagatgctttcgttgcaacaaacatacggcatcattcggtctgaaaacggcagatgggcaatgcagaccctcagttgtggcagaatcgtggcagatttagccactcagaaaaccttcatcattcgaccacaggccaagtggcccaacccggggtttgtgtttgtcgggctagatgtgttaaagcagcggcctgtgttctacaggtgccacatggcctatggtatcaaacaagatgctgacgggtgggaagatttggatgagagttacgggcgaatttccaacatcaaagatacgggcagttatctcaagtttcgcgaccccaacgagattgctgccaataatcatttcagaatgattccccatagatacactgtggtgcagcccaatatcagagaccagtcggagatgagtgtgcccttagtcatttgatagatagatagatagatggatatgatgacagtactacggctcagatatgccttttgctggcttcagcagcaaggtcccggagaagcagcatcatttcatctcttgagagctcattaatcgactcggaaaagctcagcgtgttcgacatcagcatttgaatctggctcacagccaggcctcttaattcgtcgtttccagccgcgcagcatttgcgccacaggatcatagcttgggtaattgccgtgtcgaagcttctgaagaaccgttcgacaatcgccaatagttcgggaagttggtacatttgcgctaccataaccagttccaccgcttcgtcaaaatggagattcaagtcttgtccatgtaggtaacgcagcatggcttcgactgttgattctggagcgtccagcgcgaccacgttttccgacgcttcccgcatgcccgaactgagcatggtctcgaagaagggccatacggccgtcagcaccggtgtgaagacctccactgtctcttcatctgagcccttgatgctgaagtttggggcgcatttcgttctcaccagagaaaggccagattcctggatggtagtgtgaccagtcagcatctttcccacggactccttttttttgtcggtgatatatgctattgtacttcgtttggaccagtcgtccgagacagttacgaacacggtttcgctatcgtcggagagaatgaagctccatagtgatagggcgacgccctggccaggaatgtcggtgacgtggagctcctctttggtggtgtattacacacaaataaagatcaacaaatgtggaatattacttgacactctacttaactttatactggtgaaatagtctgacaaatacatgtattatatacgcctgaggaagacgacagacaattagatcacccagaaaaataagatgttcaatcagccatcagaatgctcgattaaccatttcaatgttgaattagacatcacaatgttcaatcagatatcctgaaaacttatactctccaagtagtgcctctgagaactctcccaaatgactggaaggctccataaacaattaaaaagtacataaatatacatttcttgtggttcaaaatcgtttggaacgctgaaatatcttttgttacttctgtgaagtcctcaatcgccggtgaaacttttcatctccacccataaaagtcacccacccaaaagtgaacccatcaccaggttgtatagtgtagtggttatcaccttggattctgactacttgcagttgacttccagtaaccccggttcgagtccgggtacgacctttcttttcagcgtctcccgtgctttttgtgactccattcctttctggcaagtccaatcgcacttgtatccatttcttttcctctctattgctgagtaagaaaaatccgaaactgtaaaaaaaaacataattaaagtttaataaattggaagtattataaataaaacgcgcaacacgaaactcattaagacccacaaccatgtcaatactgcgggttcctgcagaaatccagcagatgtttttgcaggacctttgcttggcgtcgttggtcgctctccacgacgcgtgccgggaatttcggacccttttagcatctctggatggctctgtcattcgagaaaaagtcaccgagcgggtcccgtggatggaaataggtcagcctggcaccggattgagctcgtggatggactgtgctcgtctaattgttgctcggagacaatccatgatctcctgtccgcaaaaatggctagatacggtcagatacggcggtctgttgggacggattgtccagaacattgacctggtatacattgaacctatagagctgaacaacaagggaccaggtcaggaatatgatacccttccctcgagttacaagcccgtcttttctactacaattcccactccctgcggaggacttactggaaagtacatggaggtgcagagcgacaagcacgaggacgatgaagaaccagaaaccaggtacattgatctgaccacgtgcgagtaccaccacgttcacccccatccgcgccccaaaccggctactttgaccaagacaatgttgagtaaaataaccgcctcgggagaaagtgtagccatcattcccaactccgacgtccgggtggttgaccggaatggactgctgttctttgtgttgcaagaaacatccaagtgggtggtggttcgccaaagtggcggcgtcgagggagaggtttcgtccaccaagtttgtcattgacaaggaccgcaccgtggttcaacaagatggacagaaatacctgtatttcgactcgcacactcacgagaactgctcccgggtctcttcgcccagcagatacaccgtgcttcacgttttgcccgactctcaaggagccattgttctcgagtatctggaagatgaagggctgtggatattctacgataatctttccagcgatcaagacaagacgctgctggtgtcgcttcctctacaaaacgacgatatctttgaaacactgggcaacgaaatgagccttcaaggcactcgaaggcagctcatcgtcacctatggaggaatgctatactttcagtggcggcagcgatatctcattcctttgtggatcgactttgtcgacgaacccgggctgctcaactcgtcgcagcacacacttggcggactccgaacagacatgaagaccctgctgctggcggccaaggagaagcctgtcgcgtttggagacggaccactggagtggtatgctgaaggagttgtgcagtctgaaaaccaacggtgggccgtgcaaaagacaaccgcaggacgtacgattgtggatctgagcagacagaagacgtatattgtacgcaccggaaaccgtaccgacgagaatgcgcggtgggaggactttgtcatcgttggacttgatgaagctcaacagcttccagtcttttacctgtgtcacctcgacacgaattggcccgacatgtttggtagcctggatcacaagttggcctgttttctacaacggagacgtggcgaagagcacgaggcaaggctagatttgaagggccaacaacgcagaggcgtgattcgtcccaatccccacgaccagaaccagaagggggttccgctggagtgggagaatgagtgattgtgccgttgttctcgtcagcagcttcagggatagcccaagaaagaaagaacaaaaattcaagcaactccaagtcacgtgtctactccgatacggggaatcgaaccccggtctccacggttctcggaatgagagcgtgatgtgatagcccctacactatatcggatggtgggagccgcgacgggtgggcgtataagacctcgaaaatgtggaaaaatgcggcaaaataacggcgaattgcgaattctagagagtgaggcatggctagatggccagaaaataatcaagagccgtaggtgctctttttgtgtatgttctgacatggatctcagactccatcgattcgagtgtggaggtggagaaggacccgaagaatatcacatcggtgccaattctgactatgcaatcatggtcattcggtgctactgcacccagcttctaagtaggtgttcttttgtttggctatagtcgaccaggaaagctcactctagggaagtacattctcatgcaaacgttctcaagttggcatctatcgacctgattggagaggccgacattagtcaagagaccgcgtgccatgggtcacatatacacgagatatatctgttggttgtatacggttacccagtagatgttgtttatctaatatatctggaatcgctttagggatcatgatcaagctcgttcccgtgtgtactactagcggaattgtgcccctagaagtggttcagaagagagtcagggagtccgaatgcacaaaaaaacaacaaaaaaaaacaccgctaccaggatcgtcgccggaagtaatagcagtagtaccgttagggtgcagactcagtagctgaactgagcctgacagtctcagaattgggatgaactgttgattcaatagagactcggaaatcaatagtcgtttcgaacatatttgtgttccaattagtcgctcgcaccgtctccccagtgaaactcagcaaattaatctttgaggaggaaactgagaagatcataggaacccgatacagagtgttcgattttcatcataaagggaactatgcagtatgtactttaccacctgaataaaaagtttgacccataatcagatatacggtagtactatttccatggcggtatatctgaaccaaagctgtagacactcaattggacactctactgtgtgaggattaaacctccagtaaaccgttacaaggatcagtctgagtattctgacaatgagaatgccgttgactagttgtgtttggaggaataacaaagatcaatgtgattattgtattataacggattgtgggtgattttcggtctgtcatttgatcatacgactgtatttataatgattagggaacatgtaaagatctgagaactgtacagtattatccaagtaaatggtaatcaatgtttagaatgttgtaataacttgaagtggtagagatataaattattatgattatttatgttgagatcaactacctgtaatgtgcactacatactgtacatactgtacttatagtgtagatatatagtaattatactggtttgagcattagatataagaatgtataagtaaatgtagcaatatcagaatgcagtacaagtacacactacaacactacaaatacactcttaccatgaagtacttgtagtgtaccataaaggagacaagaaactctacaatggaaataggaacgcatttataccatcatgatgagcgaccaaattccgtccatagcaacccgagttggaatcttttgatctaatgataatgtcgatacttacaaagaggaaatacgattggtaatcagatctcagttgtcgtttttttcctatggaactgtgtaactcgtttccagacacgaacaatcaacatctgatgactagctcccttggtccgtagtcgctctgaatgacactaatacccaacttgggttttcgctgagcctcgaaatcaattcaaacacgtgtctacggccccgtttcagaggcctctagaccatgtgcgccgcttactggtttccaccttaccattgtcacgatttttacactcatgcaccaacatgcgtctctcctgcaaagacgccgaggtttgaaattatccggcactttatctgcaataatatctccgattgtgcatatatgacgcatttgtcgatgaactatttcagcgaaaggatgaaagaccaagatggacaaactaatcgtgagccgtttcatacacggtccaaaatgaataaaaatgatcttgtgttgtttctcgctgtctttttttggtataatctgtagcaaaagtaccgagtggaacaagccatactagaccacaagtacatactgtagtaactctctactgaacatactgtactgtacgtatctaatagtatctctctacccatcttttagtctctataatataccatccccttctggaagttgcctgtggccgtcttgggtcgattggtgtaaaaataacacatttgtctcaggtcaaggtcctaggggcagccattgacccgaacagttaaaaaggcgtgtaaaaatagatcttctagaggagcagagtctggaataatgaagcaattccaggtgggaatgcaatctctccgctgaatagctctggttgagcactcgtaaaagtgttcctctggttcacttctcttcttcaccttgaccttctccttttctctgcaccaccagtcgatgaaagaaccacccaccacacttcacggatcagcaaaccctgactcacacaccaagtggacaagtgccacagttcggtatccgtccatggaccccttgtagagtggagccgtgcggaaattcaaaaaaaagcaacatataaataccatctgatttccttctcttctcaattcaatccataccaccaacctttcaatgctcttttctaccacaattctcactggtctcttgtctctggctgtggctgccccaccaagcctggatacgtgaacatccccctcacccaccccatatccggggtcaagaacggctccgaggtgtccaacgaagagtttgttgcccggctgggctacaactttgtggagaaaaatgtccgaaagtactcctctgagctttttgccgccgggattgtccagaacagctcctacgctctctcccttgtccctgccaacagctctctcaccagtgagatcacttttggaggcgtcaacactggccggtatgagggagacctcaaggagatattcggacaagccgatcccgaccaatttgtgtttcgggccggcggaaatgtcaacggcgctcccttctccaactcgtctctctggttcgtagatgccggaaagactctgacatacctcaacccggcgacctacgaggttgtctttggagctcttttgcacaatgcaggaatccgacttttgtcccaggacactctggccacttacccgtgtgccgacggagccaaggctaccttccgatggaccactccctcctcggccattgagttgacccttgcggactttggaatccccctcaatgacgttctgaacaacggagacaaggaaaactgctttgtaggcatcgcaagctccactttcaacaatctcggagactccaatgttcttggatccaactttctcaacaacttttactccgtctttgacctcaaaaagaacaccctcaacctcgccaaacctgctcacaagccggaccattaccaggctggatttgtcgccagcttcgaatagtttgtcaatctagagatttttccacattccttttactccaacacaagcagtgcaatagagtataccattccttcaatacagtatgtaccgtccataggcgtatcagagtatcatgttacaagtcgtcgttcgagaagacattgcaaactggtttgaacaaacaatgtttcccttcctgattgtagacaaaaaagatacggctttgccatcacccagaatcgaactgaggtttccacgggcttgttatgaactgaagtacactccacaacgtggtgtactaaccactatactatgatggccggtgagattcgaggaacacgtggaaccgccgatggtgaattcccttgttttgaaatttccctaccaaccaacagacaggctgttgcgagttgttggaaatcaggtagcgtttccagagttggcagccaacagtgagggtctacatcttgccttggaagttgttaaaatgacagtaaccgattcacaaaaagtctcggttggactatataagccattatatcgccttttcgtctcaacaagagttctccttcgttcagaggtgtaatcaaagtcctcagtcatctcccaggcccaggactagaatacaaatatgaatgttgacaaacaaacgtggtttactctttcacacgccaggttgttcctgcttgtagtccataatatgtgaacgggtcgtcaattgtcgtaattgtcgtaattgtcgtaatggtcgtaacgaaacagctccattatgctgtctcagatattgtttgttttggcattccctgctgttgcccgattaataagtcccaccatctaaaaccaaactggatcgaaatcgccgtcgccgacctcattcatggcctcaatgcacagctcaagttcctcaaaaatctcatccatcaccttctgaactcctggcttgtcttgttcacagcactgttggtccagatagtcatgcgtgtacttccacactcccatgcgtccgttggaaatgccaatgacaggaaggtggtccttgtcgagatgcacagccgttatcagatgccgtttgaggtcgacaacaaacagaggaaacagtccgccggcagaatacgcaatcccgtagcgcggatgtctctcatcgtggcagatttcgtaccctcccattggtcttttggtgttgtcctgatagtgggccgagacgatctgaagatctctcttctcgttgtagatgcccttgtataaacacccgttgtaatgcaaccacccataaggcggcgaagtggacccgccaccgtcttctacgggcacaagcccgcggcctggagcaacacagtatgttccctcgttttcttcgtcgctgtcgcatcggtacacaaacgccacattgtcaatctgttgcaactcgtaggagtgtaaatacgacgacgacgagctgatcaagaactcgtggtagtcttcttcaccgcggtacttgatctgaagaaccacttccttgccgcgtcgcgccagcactgtggcggtgtcggtggtgtgttggtagtggatgtagtcatcgtcggatctcacgtttccaaagaagaaggaccgggcttcttccttggacatgtatgtgtcagtgccggagtctgtcctgagatccacaaacgatgacgatgtctggtcgtagattcctctgtcgcagtagttccaccagtaccgcgacttgcgctgcatgtctccctgcagagcgatgaagtcgtccggtagcggcttgttgtagtggtcgtccatctggatgtgtgtgaaagccactgcctctttgtggctgttgtagttgtctgctagcgcctgccacgagctccagtcgctgtgttccaggctgaaatacgggcatcgcagcagcattttgcggatgtctgagagcgccacgtgctgtgagcgcgacgtttccgccagagcaagaagatcccggggctccaggtaggtgcacaccatcgacaacagttctggcggcagcatcggcttcgggttgggacagtgtcaaacaggagaatgtcaaggcccactgccgaaccaataagccgttgggttcgctacagcaagcatgtacgccgtgcatcgatcctgcatttttttcaccagccggacagcaaccataacccgggtgcggcggaacgcgaggtggagtgggagctgttgggggggcggatacagggtcaccagactacagagggacgtgaaaatacggcatacgtggtctccgacacgcctaactctgtgtcgataggccgtcgaggcgggttctgtttcgcgatcgggacaattacgtcacagggtgagaaaacctaacctacggtgcataaggggcggagagaattgtcaaatatataaaataaaataaaataaaataaaataaaataaaagattgattctggcaggattgaaaatgcaacggatgaactgaacaaaactgaagtgcgagcgtgttacttgtattatagatcaaatgttcaggaattagttaagcagatgccccgtctaactggaccaagaaccggaggtgggatctggggtaaagggattttttaaaaataaaataacaactcgtatatccctattttctacaagtctttggaagcgtgagttcgaactcgcggatatcaatgtttatacgagagcaaaaaggactccatgaatggctccaaaggctccaaaggctccaaaggctccaaacgctccaaaggctccatgaaaggcgcaaataagagtcaaatcactgaaaactccaacaccatccgtcactcaatccattgcacactccccgaaagtcaactcccactatatcgtgttgggcggagaatctaggaagtcgccatacgtttggagaccctactttgtgacttgaacttcgggcagggtgcgacatctgcgggttttatgacttctccgaggtttccactctctctacacgaatatcttctgtgattttccggtggtttatgaatctcatctcccacctctgatctagagaacaaatcaatacagacctacgccatctggcagtgtacctcaaatttttgcttactaagagcaatagaacgatacccttccctcatttcaagtcagtccacgcttacatcaagagaatcagatcttcatccaaccaagatacgtatctcatcctcttggtcagatatcggacgttggtcgggccaaaatggtttagccagtcaaccgacgttcgtaacatgtggtggaacaccgaatggaactacgtcaccatagatctgtgcggaaaaatatacctcatcacttggaggtcaagttgatgagttccaaccaagccattcaaaaccacctgggtctgttaacgtcagtggtcaattgttttgactctttcccagacctcctaaatacattgtaagcagaggctcgagatgatctgagtcggtgttgatcgagtctgtagtgcggtgagaagttgggccttgttttcacgttcttagcgttcatctgtgccattacttgtaactatgattaataacacgaaaatagtaccactccttacacatgtagtgcactcgcatcgtgcaatttctctctctcttgcagggcttacagtctctgaaaaaaataaaaataacgctgcctctagttaagattatttagttggtaatagttggagaaaaatggtgctgggggtacacatttcagggtttccggcatggtaacaagacatagattgtatcaacagatagaggatatccatgatctaaacagatatacaaaaatatcccactttaccatactgttatgtcacagcctcccatttttcaagagcagagttaggtatcattggttgacccgttgttgacaaatacttgagccttaaccattaatgttgacatgtacattgccgtctcggatcagcgtgggggcgtttcgtgtttggcggttcagggtcacgtgactccatgatctgagtcatatgactctggtatcgtttcccaatcagttttaccgcatgtttctctcgtgcctcttgcgcaaaatgcaggtcccatcgtagatcgccgaagatcataggctaagtacgacaagcagaagagcgctggggttctgagtaatatgagtacgagtacatacatactgtagggaagttcgaatgtaaaaaacaatcacagattgcaaaagattacagcacccaggattctcgtatggtctcccactacaatactaactgggctctctggtgcttgactatggctgatcggacgggaagccgtattttcaccaggatatggccgtaaccaacctgcgccgacccggaatcgaaccgggggcccatcgatggcaacgatggattttaccactaaaccatcggcgcattagaggtatttttcatacctgtttgagcttactaatgcttgaaaaagtgtaaaaaaagtttttggtgataaatggccataatcggggtgttagaggaaggaagacttgagttcttgtttattcttcattcaatttggggtgtagagtggtccttgttctttttgttcttttagatggcttctgatgtcggacgtggcaacaaaacaggtgcaagaacaggtgcaagtacagtatgtacagtaagtacttcaatgacaaccacagattcttcacaatgattaccccagctgtcttgatacaatgtagaagtttttactatactcgtacttgtattggaatgtacttgtgcttgtacttgtacttggtttgcccagcctacacgtctgcacgcttctgactatatgcgtatgtagataacagataacatacaaggaagaagaaagaagagaaaaacaacatgtatccataaaacactcgatctgcaaatcgtcattctcatatacacctgggtattggtgatgtaaacagtctctgcaactctctgcaatgtgtagtacagtaaatgatggttctcattacactcagtggtcagtcactacactggaaacaactcaacatgtcaactagagctccaacacgcgcaaattcgggcgaccttcgggaggaaaacgtgttttttacagctcgaaacggccaacaccaccccgaaaactcatagcaagcggatttagctcagttgggagagcgccagactgaagtcgttcttcggtcagagtaatctggaggtcctgtgttcgatccacagaattcgcaattcttttttccattggtttctgtgctccatcttacagccgtatgttctggtacaggttggagacattacatcgccacttttttagagtttggaagtttagttttttaaagttccaacccccacttgtccccacatttataataatttaatttcatgtgggacttgtttttttctcagaatgactcatgtataagtacagaatgtaagtcggcttttggaggaataggccatatagccgttttaatcacaccaaaagctgctcttaccctgtagtttcagctgtcccctctcttcaatccttcactttcattgagttcttacaaccattcacttcctgtaaaattggtccagcggactgaatagagatgatatcataacataatgggtatcatgaatcccagaagtgtaccaggattatttctttgattccaaattccaaatgctttcttcgctttttggagttctacgttgagtggtcagaagtgtggtgttgaagtagacctcccatccactgtctacaactacggtacagtatgtacagtaatataccaggtagagtatatgctcaggtaccatttgaaaacggcacatgagcacatactctatatggtatagatttacgactctttcattaataacaaactactccagactcagagcctccaaagagatgcccagattgtccatatagacgccctctcgcgtgtggaagtcggacgcctcacaatacacgttgcgttcgtttgcgtttctgagaagactctcccatttctcgttgcttacgagagtgtcggcatttccaatgatccacaaggacgctttggctcgggtgatggccacattcatccgtctgacatcggcgagaaaaccgaccgtgtgggccgtgggatgggctctaacacacgacatgatgataatgtccttctcacgaccctgtaaactgtccacagtttggatttccagcgtcattgtctccttttctgtatcatatctctgttcaaaatggtgcctgagcttctcaacctgctgtttgtacggagacacaatgccaatatccagcttttcgcctgctccaacgcacttcaaaacagcggaaactagtttgttggcaaactgaatctcagcggtgttgcagaaagaatgattgtctccaaacttgtgctttccttcaacgttgaaaaacatgtaaggaggcagatgttctgtggagtgccactttctggcagtcttgagctccattccgggagcgtccttgagaacgttgtcgtagaagaaggctctagggaacagagagatgttagggtgcattctatactgggtgtctagaatgtgcatggcatcgggatgagccttgagtatccgtacaaacagcgatttgtcgtagtcaaaatttccagcctcagttgacaaaactgtgggcggcaactgcttggggtctcccacgagaatgaccttggtgcatctatattgcaaagggatcagcaccgaaggctcggtacactggccggcttcgtcaataatgacagtagggaataacctgccgcatctttggacgtcggtgctcgccgaccctgacaaggtgcaacagaaaacatcgctctgttgagaattttcgcgatgcgctgggctcgattagttttgatctgatttcggagcaaccagatctttgttctcagctccataacctgtgagcgaaggccatctatgtcctttttgactgtggtcagtttcgacttggtggaattgatagagtactgaacagtagagccagaactcttgaatagcaggttgagcttgttgaagagcgagtctttggacttgtaaagaatgtccatttctttttccagaggtcggagaataagtgtgagggcgtcacactcagcctttttggtggcttcctgatcactggacgcacttatcatgcctcccagtgtcagatgggcaacttcggtatgaacattctccggacgtccgatacgaagaattttgtagtccagtttctcgtccaggaagtgcttcttgagtcgcttggtcaactcgtcaactgctgcattggaaggcgcacagaacatgagtggtctggagccagattccagcagttcgcgaataatagagacaatggtgcttgtcttacctgttcctgggggaccctggatcaaggagaacccacctcgagtattgagtgagccatagacggcctgagcctgagacctgttgagcttgccgatgtacttgtcttgtaatcgttggatttccgaatcggggccctttggaaatgaataacattggccaaacaagatgtcgttcttcaaagcaaaatctccaatgctcaaaagagccagtagttctcgttcagcggtggccatgttggtgagataacaacactcccatagcgacccttctctcaagtccgcacgtcgcgttcggatccacacatccatttctcgagtcttcttgttccagacaatctcactgattttaccaagacacttggcttttccacttcccggaaccgtaatgacgacgagtgtcgaactgaacagctcatgttcttctagttcctgctgggtggctcccatgcagatttcggtgaagagttcgttgtcgtctccttctttggtagcctgcaccttgaaacgaaagcctccgaaacgtctggccttctcctggtctctgaactctgcaaatacttgacgaatagaagcgtagcattccagaagattcagaggctccatgattctcacatactcgaaagaagacttgtacttgtcgagagcatcttcactccgagctgacctgggatgctcgtgcttgagtttgcttagatcccattccaacagatgttcatagagatagtcaagagacatagctgacgagagtgataaagcgagtcggtgaaaacgggtcagcggtattcaagcctctttatatatcaatctacagagtcactcaaaaccctttggtgatcaaaaactaaaccatactcgcccaaccaacaagagataagtgaaactcactcagtttcccaatgactgctccactcagtaccactgtcacaaaccgattcttccggtcaacccaatgtggaaattacattcaaaacgtcttcccgtatacgcgtgtccacagttgaaactacaaaccactctaggttcgatgacggtttcaagagctgaaaatgctctccaattggcccctgaagctgcaattgtgttcctctaaagatattttacttctgtcagaacattctcgaaccctgggcatagccttggtgattctgcttagatattcatccagacctctacacacggaaaacccaaactgcaaccaaaactgcgactatacgtttgtccactcaggttttgtatttagatacttttctgcgaaactaatatctgccgctaaattaatgttggctgctaaactaatatttgccaccttttctctccctggtacgattattatctttctggttgtggtgccgatccgcacgctagtgaggactgcgtctagtggatgttcgggcgggttcatctcgaggagcccgtcaaagtcgtcaaaagcaagtgataagtaaacagctccatatgttacctacagtacatcctgtactacttgtacgacaactctctgttttctccctattacacaaccaacacacaactttcactgcttgtttcactcagacggctctctcccacgctaaaccatacgccattcattttcaagtaggtgaagatccgtccgagcgtagattcaagtcagatatacatacaagtatgtactgtacagtacttgtacaatgatctccacgcaataatcccattgttgactagaagttgctactcctgcacggttacctcggcataagacccaggtggtaggaaagctctgctctaccatccactatattacagatatattacaaaacaatataaatacacgaccccgtcgtcaagctgtttgctgtcaaggtttaattcagcatcttgtcttcctttgctggctttgctcggctactaatcaaccaatccctggtggtaatccaaaaagtacagcttcaaagcggctctcgcaatcacagccagagctcccgcagagtacggggccataaaactgctcttcagatcctcatctgcgtccaacaccttatcgtagtactgtagcaggtgttcctttcgtagttcgtctctcaacctttgatccttctgactttcaggccaagctgagtactctttgagaacgtgtttgaggatggaatccatgcgagtgatcaatttgatgtactttggaaacagcttttggctgcgtggatcttttgacagccaattctgctccactcgcggcttatacatggttttgatgctcttaccggagatggtctccgaggtgtaccatctataagtgtcctgacaaagtgtcggagaactgggatcaataggtttaagtcgtaattgtgttgcggttgtccatctgaattctggtgctttcccctgcgctattcttctgttgtctctttcgatttcctccttggttcgtcgtctccgtttgaccggtggaggagacgacagaggcgaccccgagtcaaagtcctggtcgatttcctgtacgctgcttcgacgtctgattttgtgcccgctgttgccattgttattgctgttgtggctgttattgaggggtagtgctggtgtgataaccgcactagtcaccgttgtcgggtcttcttgcaactccctgtccactttttgtctcaatttctgaacgcgaattgcatcgcccaattcggctccggactcctccatttgcttgtacacgtctgtgatggactggaacggcactagacgggccatggcgctttctatgctcattgacagtcgctttttgaacgcgagagccgcgtagttttcgtcgtcaagctcgtagaccagccgttcggagaactccttgagaatcgtgccgaaaagcgacgtccatcttgtcttctcggcgctggcagggatggcggccacttcatttttccagcacgtagtcagctgggtcaccagctgttctcgaaggcggccttgttccgccacctgatcctgtttgtcgatcttatactgtgttccaggtcatccagaaggtttattttcccgcccattgggtgaatactgtgttggtcgtactacaagtagcctgttgtagtgcatgaacatacccacttcgcgcagttctggctcatgcatgagccatgttcaaaaaaaaagttcattgtgtgtggaatacacatcgatcccatacctgatcgagaagttagaactgtcgggtttttattatcgatttaagccgagactgttggcgatgatggaggaaacccatgtcaaaattccgtctcgagacggcttcttgtatcttgttgtacccgagttgacgattcattcactggatagccttgaacacatgaaccaatatatgatggtgaaacattgactgacggttggcgagttgcgtagatgtatgtggcttggctgatttatgtggagaatcacatgaaagataaatgaccggcagttgacaagggtggtacagcattttatgtgggttagtatcaattagttgggtttttgttgagagttttgttgagatgacctgggagtgaaaagtagttgaaatttatgaaggaagggaaataaaaaaaaaaaagtagagagtcagatggtctctactttcatttaatatcatatacagtacagtacattaaactctctggaatatactgtatatagatatatatattttatgagaagactggaacgctcagttgcatatctttacttggtaaaatacaaactgtacatagctgatgtttacttggttcgagaaagaccctggagcctacagaaacatatcacgctactgaccataaataaatgccctcgttgcagttatttgaaatctggaatcggtaaattgtctgtttcccaatcttctttattcttctgaaaagcaatgttcattgtgtttctatactgaacgtcctgtagctcgcgctccaggccgccgatcagtttcgatcgtcacgacctacaataagtatatttcatttccgaaaagtgctttccagtagtcatgatgatatctccaatgtcagaacttttccagcctgcccattccaaattcacccccatcgaaacgaccattcgtggtcgtctacggatcgtgtaggttgtagagttttctgcatttatattcatttaattataactttgctttgtaggtacttcactgtattttttttctgcactgtagtacttgataactatcccccaccttccaacttccaacaaccttacttcacctcccaagtaccagcttcacaacctctctcactcagaaaataaaccccttgaacatctacatttcaacagaggagatgtcataagacccagcacatggcccaaggaacagtcacgagattagccgtgtgattttgtgcgtttctttcggtcggcggcgttacattggcatcccacattgccataatagagctcacctatcaatttccacctgttcgagccagagtgattcgccacatgttcagtcgacacttttgggcacacgtgggacctgcggtcgccacagaaacctgcagactcgtttgcagtctggtttgccggtgccggcagaaatggagcagaacaaactcagacgtacagtacatactgtactcgcttcgtccatggacatggaacaagcaaatggagtcccagcccatgttccatatccaggcacttcagggcaaggtcaattgcatcgatttccacagaagtgggccctataatttgatcactgcttcatgcatataatgaactacaaggacatggaggggagtgatcgatacgaaccctgtctatacgtacagaggccatgaaaatgtggttcgagagtttctgtggtgggcaagagatggactcaataaaaaggtggacggccgagaattccagctggtcacatggtctgagtattgtaacctgcgtctctggcaatctactcctggtctcgaaagccgtgtcaactttgtgcgaggtgacaagcctgtgccatacaacctgatacgaacggtgcaccatacgttccatacactcacgagccaatgggatctgattcattccctgtgggaggaattggcattggagggcgacggtcagaatgtagattctaggcatgacagttttggctgtcctcggcagctacaatgcgtacataccaacgtaaggtcatctcagggcaagaggaacatgaatttgtgaaggctctcagatgttctcgttggtgttgctgcctttgcttcccactatggctcgtttgaagaagaagtgggagtatttgaggaagttttatgccaacgtcgcttggagaagcttcctgtgggcgaaaattttccgaaagtgtgatttgagaagattaatgtgtcaacaggccaagttgaggtgactctgaatggtcaactggatgaaaattaccactttaatcattgactgcatctctatcatggaatgtccaatatctgcagaccttgcactatcatgcactatcaatgcaatattaacttggccttgaatcgagaggtggaaaaaaatgtagtttctggatttttcaggaaaaggaaattcccttaaactctccaatccaagaggatttattggatatcaatatcaactcgtttgcagttagatacacatgagattctctatatttgtttcatttgttttgtacaatcagcttgttttttttcataatttcgttcattacttgatctaactattcaactggggtacagctaaaagacagcatcctcaagagtcttgaacttcttgaggtacttgtttccagatccattgacctgacccttgttctcggcctgtagcaggtggaggtagagtccaaaggcagcgtcgtcgtagttgtgggtctcctcgttcttcttgacggtggctcgagcctcggcgatggactctgcaggcacaatctccaccttgacacccttcttcttgccgtagatctcgtagtactctcggaaggtcacctcgcttcctgacagttcgagaacgtcggggatctcgttaacaggcttggacaggaccaccgccagggcagcggcaatgtcatcgaggaaggtggcggaccacttggcgtcggggttgatggggttggccttgttggtcttagggtcgagtcgcaggaaggaggggtatttgacggcaaactctccaaagactccgttctgcacagcgacaaccttgagacccttgacggcccgtgcagcctcaaggtggttcttcttgagatccaggaagtggaagtcagggaattgggtgtagtcgactccaaactcggagggcacgtagaccttgactccggcggccttgacggcgtccagaatgccggtccagttggccttgaccgacgagatgttgagaaccacgtccacgcccttgaagatggcctcgagcgagcccttttcatcggccgagccctgcacgtacttgaccttgtctgtgttcttggacttggaggcgtctcgggtgaccacgatgatggggtatttgtatccgggggccgcggacagcgcgttaatgagaggagttccgagcactccgttagctccgacaagtgcgactgtagtcattgtgttggtgttggtgttggttggtggattggtgtctgagacagatgtttgtggggagcattgtctggagcctctcaatggctatatatacgcccgacgcccttgtggctccaattgagtttggatctgtcgcggtcatcgtcgggatcgcgtaatagcagcatgccagatggataacaaatcttgtctgctgtctgacaaagcaaagacaaactttggcagcgcggttacagtacgagttatggcaggccagtagctattaccattttattgcgagtaaaaaggggacaaaatcggaggcaaaaaaaatcaataataaccaagctgcggcggaaggaataaatccgggctttttttccgcccgtaaaacccctcattcgctgcttaatctgacactaaactagcggtagcacgcaacttctctccactatgaggtttggcggattttcggtgacgcacttttttcccaatggggatttagcgttcgaattttgtcagcacgatttatttctaatgcttagaaataactaagaggggggattacacactggttggaaatgaacatggcgaagcagcagcacatttttcaatacaagcgtggtgacaaaaacaatgaaacaatgatgcagaggtgatagcaatcgcaaaacaacaacaaggtcgtcaataccgctgtcaccctgcacagtgcgctagtctgcgtgggtgggtactacctgaactacaagtacaagtagatggtatacaagtagcacaaggctttctagctcattccctaacagctcattccgatgttactgtacaaatcgtcactcgtaccggtaccttcagtctccactaaaggtggcttgaagagcacgtcgttggagagaaggtgcaaaatgttgtactccaccagtaactttgcgagagtccgaggagtgcatcgatgtggcacggcttcaagagcatgatccacggaaagtctacgagtattgcgtgtattattagagggcatttatgctagggtgagcgggatttgtagtagtgtacagtacgagtaaggggcattgattaggagctggccccttcggtctcgaccacggatagctaccgagacgaacatagctctcagacaccagacaatactgtactctaggtgtactatactcgtacctactctcaccgtaccgcccttctacccccactatgatacttcgaaaaagaaacgccaactgtaaagacgggaatacacgcgatacgctatgataggtacgaatagtcgttcttgtagtaattgtcatggtttgtcggattggtcatccccaaccaatgcttctattgacgctgttattctctgatagagccgtccaatgaggccttgagactgtagccgctggggggagacctgcaacgatgtggatcatttgttccccaaacaagcagtgctcgtaccggtaactggtgacagacttgtgtcagattaacttgacactcacacgaccagtactgtaccatcgttagactccattgttgtctcagactcttaaggctgatggtacgagaactgtgcgagagcgagtacagtatgtacaagactaacttatctccaaatgcacaccccctaactccctacgtctacacccatcactctaacaatgcctataatacatacataccgtcctgcacgtgtgcgtgccttactttcttccctgccatcctctgttgatcatgaaccgatccaaagactcccagaaccgggccacaatctccctatccttgaatcgctgtgtcttgtcgattcgaaccacctccacgttccagttggtcactggaggaggcacagggtcgttgttgtagaccaggcaataacctttgactctctggaacagttgattggggtccgaccaccggtacgacttgaactgccactcctggccagtggtaaacaccgccaccactcggtcccagtactccggcttggtcagcttttcgtggctgtccacaaccacatatgtgagcttgcccatataggggttagtgtggttgagccgtagcatatcaatgccgtatgccgattgaggttccacaaagttgccgtactccaaaaattccttgacgttgctaagagtgagcagagccgacgcagatggagacagcaggatgatgggctcttttcttcggtcatgcgcattctgctgcttagacgactcgtgggtcgctgcaggcttgcccttgtgtttgagaatattagtgtagcagtccttctgcaccgaggagaagtcggtgggcttggtgcctcgcagcatggagttgtggtcgtagggagccacctcgctggctagaattcgttccaaccgaggatcgtccacgtccatggcatcggggtccacgccaccggccttgtcttccttggcatcggtctttgtgtcgttagcccctcccttgatggcgtcgacgctctcggtctctcccttgagccacttgatcacgtccgagcgctgcagaaacgggaaatgtgtgatgccgttggtgttgcaaaagaccacgtattgcgcaatgttctctccggccttgtcccagcacgcgtacacagacttgaggtcctgcggcactccatcgatctccactcgggtcgtgtcgctcagggggaacgtctgcgagccgatggtcagagcggtcgcctcggcaatgtcgtccttgtcgagcgacagagcggatccggccttgatggcgtctcgaagggcggtaagaggatccatcgttgagacgcaaagttggtgatgtgtgatggaggtgagagggcttgaacaaccttatttggacactgttgtgactggagagacagaactggtttaaattcgagtaaattcgagtaaattcgggaaaaatagggaaaagtcgcgagattgagaaaaattgacggtatcacaagaacaaggttggttcatcctccatttgttacgtatgaaacctgattcaaactctttgactgtcagacagatccgactactaacacacgggtacattatgtactgtatgtacggtatcagcatgtacatattgtacttaattatacactccagctaattgaaagtgaaaaacaagtagcaaagtaggaaaacaacgcttgaaccgctcgaggaacacggtgatctatctcaatctaagccttcaccgtttcaactcccttcttcttcattctcatctccccgtcgggtcgtttctctcacggacctgggcaccgcagttcgaatcctcccaaatacatttccgtctttatttttccaccacattacagcgggtttcccagctctatcatttgacggcgtaatcaattattagtcaccgaaagcacgccaataaaagctcctaaccaatgcaagtcgttttgtcaaaaatgttttatctattctgccttggagattcgaaagactgtagctttacatactggagatatgtttccatgatttgatgtccattgagacagccaatccaagtttacaagttataatacgataaaacgggtcacaccagtacagcactcgtaatgcaatggctacagtgaagaaatccattctctatgagttcccctactacacgtttctcgcgatccgttgatcacaatcagtttctcattagtattagtacatagctgcgtgtcatcaacaacaactactcttctgttcgtcttcgtctgtatgcaaatagaccacactctgtctctgtctctggctgttgtgtttctgctgctcgtcggcctcccgcttgtccagcagctttgtgatgatcacctcaaatacctcctccaccccctcgtcgtctttggcggagatttcgtggcagcacgaatcgtcctgtagccattcggatgcgtattccacgcactgctcgaacggcacctcgcgtaagctgggctcgtccttgaccaggtccaccttggtgcccacaatgtgtatgatgatgtctgacgacaggttctgtttgagctccagcagccacagatgcatggcgtcgaacgacgcgcggctcgtcacgtcgtagcaaagaatcccacagctggcgcttcggtagtagatgggggccatgcttcggaatcgctcctgccccgccgtgtcccatatttgcagccgcaccgtcgtgtcgttgaccaccacccgtttgcgcgagaaggaggccccgatggtcgatgcctgcccggcctggaacttgttgttgacgtagcgggtcacaaaacacgttttgcccactccctgggcgcccagcagcacgattttcgcgtccatcgactccatggcggtggcgtgtgtcggggttaaaagtagagctgagtgcacttgtcggacgctcttcttgagccacagcgagctgtgtacgtgtgtaggtcggtttggaacgctgctgacaagacagtgttcggggcgctgctgctgtttaggtggtggctctttcctcaagcggagttaatgtatatcgctgtggccttaaagctaaactgtggagggggtcaaattaaagtggcaacggctcaggagatgggtcctgtagacgagggttagatgttgcgaagagcgtgattttcgacagctgtaccgaccacctggccggtatataaacaacaagttgccctacgggtccctttctcctcatccgccccaagcccacaagcccgccatgccgtccgcactaaaatgcttatctgaaatgagctcaagcggctggaggagtgtctgcttactgtgctgggtatgctaatctcgtgtggtacgagcccgccacaaggcacccagggctccagctacatggtgcgacacagatgagcaggttctcctgtcgccccgatgtctgaacgcaggtgttttttcgcacagatacgctagtggttggccctgagtgacgtcacaatacattgtccccaccaacattccaaatacaggtacagtacgaggacgagaacggcacgagtacatgctgtacttatactataaaaaaaaaacaggcggcgattttcttgctgtctttttcttcgctttggaccctccgtcacacggtctcttgcaagtggccaccgcacagccaattagcccgaatcagctgatcctaaccgacgttgcacacgtgcagagcgcccaggatcaaatcaaataacagagcctgaaccatgaacaatggggcggttgtcatccctttcaaaacaatggggctaaagagtaaaagtgagacagactaccgggcccgagggttgcatcgcgatgctgcgcgcgtggggtacaggatgtgcgatatgtgcctagaagatctacccgtctatctcggggggatatatccaaaccggaaacggacaccgaaaatatgccggctacagtcttgacatgcaggaggttgcagacaaggaaaaaaggcgccgcgaaaaatggactcacgaaacgaaacgaaacgagtgttgttgcgtgttggtgagtcatcacgttgccgtatttgaacgtcttgtttacctgactgctttccttgtttttttcaggtggcttttcgtgtctcggaatgtgtctcggacgtgttttggtctattaaacccaagtataacttcaattggattagttgaagccgaaggtgtgaaaaaaaaaaaaaaaaaaaaaaaaaaagaaacccccgacgaatggtgataaaagttgtatcagaggagtcggaagagagatacgaataacaactcggtctcagttttccccatgcacttgtctatcaacacttggagagtctcaggccctactggactgggtttcccaactacagtacatacttcaggggcgttggttttatggccaagatgagaggagagaggagagtggtggattgacgagattttgtacgggtgagagagattgatgtgctgaagtaggcgggagactattggacaggatatcaagtcaattgtgatttgcatcaagtgctgcggttttgttttttgaggattgacttggcaacttcacttgatcttctagatagatctacatgttagatggtcagttggtggtagtggttaacggctcagagggatagatacatgagaaaaagctcacctgataagttctgagcagatcatcaatggtactactgtatttacagtacttttactttttcctgtcggttttaattgacgctctctcatgggttgaccatctttctcggatattggtacggatggcccattacttgacaattacttgaagaaaaaagtcagctgggggttcaaaatcaatgttccagaggcgctattgagattttagtcatattatcaggtagccagagaaacttcaattgaagtcaccgtacgaatattgacactttactcccaaagtcttgatatatctgagattttctgagattccatcagtccaaattacttacactatagttgaagtaacctgttgtacagcagatccaggagatcatcatcagagtctgtatcatcagagactgtctcatcaaaggctgtatcatcaaagactgtatcctcagagaccgtttatgatcaggatatcaaaaaggtcaagacccatctctgacgggacagtccgtcatctacacccaaacttcaggagttcaggaagtttggtcaaatataaaaaaaaaaacctcatagtcgctactttcaacaatacaacactttttctggagcaagcagtcataggtaattgggcaaaaaagagcctcacgcaaagatccattctcaaaaccgccaggaatcggattttgaaatgccaaaaaaatcgacaactgcaggattcgaacctgcgcgggcaaagcccaacagatagtacggttattcgaatctgtcccgttaaccactccggcaagttgccactcggccacgaaacgcgcccatagtgcacgtgatggatttttggaatccaaccctggagggtgcatcacgtgtcctgagattattttagttgagttgataagtaattattaacaaaatggaaatatttggaaatgttgcaggggaggtagtagggggaataaacggacgacagcaggtagtttcatctgttctttccattcaggcgcccctaaactgtcaatataggttggaaatcttgaattgcttactctgtgatcatgatggtaccagcaccagtatgcacattcttgtacatacacaaatcttcaagtacaagtcgacgacttagagtgtgtctgaagaaaggattgcacgatacagtgtccattggaatgcttcgttggtcttgtttcaacacttgtttttgtctctcctgccttcgtcctttcagttccgtctatattttctatgtgaggtcgattctacttgcacagtcacattcacttgcttctcagatttggagatttcgcttcaacagacccaggatatcgacatatcaagtgcactatcaaaaaacaagccgaaccgatatgcctaaaaatgtcgatctcgtactaactggtttgtatgtacctacgtgtagacgtttcagttcaccctcttgtcatgtggcatcggtacttgtactgtacacacaagtgcgtcggaggaaaactacagctacaggaacttgaacaactacagcatcgccctcgtatataaccatatatgcttgtctccttgcaacgtcaccacctcacgtcaggtatctaacctcagctcaaaccatgcaagaggactcaccggagaagaaaagcaccgagacaagaagaggaacaaaaagaagctgctctaaggagccgtctccgataccgggaatcgaacccgggttctccgcgtgaaaggcggaagtgatgacccctacactatatcggaagatatccatgttgattaataagcgagccttgtgcgagaagggtgaaaaatcgataaagagatgggacagaataggcagcgtgaacacacaagttcctttatagacgaaataacaccccctggtatgttttattaaactctctgagtctctcttgcttaccgatagctctcttactcactggtgaccctcttactcactgacggccctcttagtatggtccctgatgtgttgaccatttcaaggagaacacagggtataacaccacctccaaggagactgctgatctcgtcacatacacttatattcctccctatctgctcaattcggaaaaactacggattaatacgccacaagagcccgtgcctgaaatctaaaacggcggcatgaaccggaatagaggtagatccgatgagcttgaaacaccacgatatattggatttatggagttggagttctccgggatcactttaaagacctttccgacgccagacatgagagaccaccttcagatccggcgcctattcagatgcgctattttaattcggatttgagggaaatttcggatataaacaaggatttctagccataaggttcgataagccaggcgctgtagattgacggattccgctacaaggcgatatacggaaaggtatcctgtatctagaagtgctcaaacaataattccatgtcgtggccaaaatatccgaaaaactccgagccaattggcccattctatcactccttgctatgatatgtaatttccggcctctgcatgagacaggcatctcatatgcgttacaccccgcggcatttaggtatttccagacactaatttttcttccacatcttctttactcatcatgctctattcggtcgcagagaacacgcctctctccaagctccccgagttttcggacgacttttacgccctcatcaagcatctggaataccacagcacgccagacgccgcagacgagatcttcaagggcacggccggacaaaaactggagctcacgcgatggttcgaggggagtcgagacagacagaagaaccccctcaacgtgtacttgctaaacgtggggaatgaagaggaggtggaggctctggaggaggataacgaggtcatgttcaaaatgtttgtgcggtgctccaactacaacagaaggtctcactggctgagcgagaaggatcccaagctgatgcgactggcagcaatgtattatctggagcaggagaagtttctcaagagcctgttcaacgtgcttacccccgaacgagctgccgtctacaccgacgacgccaacttcaccaattccggcgctcttcgagttctcaagctgctgcgacgagaaaacacccctggcattttcaacattcctcacggcaggttgagacactacagagtggccaaagctctttacaattggcgcaacggtgaatacaacccgttattatacagccctaattaggcaattgcatttattagacatgagcaagagatgatagacaggaggatatatttctggatatttcattgtgtatatgttcaaaaaagagttagtatttgtctgttaaaggttttattattattttattattatttattttcaatttgataaaaaatcaatggagttctgttggagattgcactctattaataatcatgttagtagtatgtctctatattacttcatccaaacaacatacgatggatacactcgagatttatcggagcttcaagacggacctcagcgcagcggatgcatctctgccagaatcggtgattttctcccttttcgaacgatttgctgcgctgttggccactgttctcagttcctcctcccgccgcagccccggcttacgttaccgccattccgcttctgcgaccaaaagtctcgaggtgctactggatgacccctcaaatcacgctgcgctgtcaagctgactccctcaagcccgctagtgttttctccggccggtttaaactgcatgcttctcaagctctcatctccaaagatcctaatcagcacgcccgctactcaattcccacccagtgtaagctggtatcgccggccatgtgcactcttcccttcactgagacgttctccggactaaattttatgaggtagcgatcgtgccacgataaacgtccatttggaccatgaggagaattcccgttacttcctttggtggattaacaagaaatgcaaagcagccaaccccccccgagggcaagcttcgcgttctgctgactgacatctaatccctcctgggtcccatctacaaaaccagtccccgcgccgccatgtctcgtgttcagcgaatgttctagaacctgccacaggctctccccaatctttacgatgtgcatattcgcgccaccttcgcaccgtctccaggtgtcgaacccgtctttaccttgtttaggtgccctccggtaatcacttctcctgaccggatccctcccagttcaatgctcattttttcagcggcaccaacgatctctatcggccccggcagagtacatgaaacgacaactctggttcaggtaaggacagctagcgaaggaccataaggccggtaacgtacgttatttaactgagaacactcagagcccctctggctctgacaaccacgtcggtgccctcgtagtcgaccctcgttccgctcccttactctggctttggtttgattttcccattcttacctccagcgctgatgtgtctgccatttcactcgatacactacgccgccgccttgatctgtgggcgtctaccaacggctatccttctgtcctgttttcggaccacgccgctccgttccagtctgccgattacaccgacctttgccactactgtattggcgttgaatcattcaccaccttgacttaccaccataattcaaatgataaggctgagatcagtgttttacgtctcaagagcattcttggacagtaaatggttcccctgaggatgctttcatcgatcccctcccgctgctggtgtgtgcctatcaacgccctgaattcttctacgggtgactcccccttctttcttccctgaggggtcgaattccactctccggttgacaccgttgtgagactcgcatcgaaaacgtggacccgatctctggctcccaagcgttcaaaggttcacccatcgcacctcactccttgcggctgagtcctctcgtgaggagcccagcctgtccggggatgtgttctgtaagctcgcattgcatatcaaccaaaaaagttaaacaagaaacacaggaatgcaagtaggcagctcagtatatatcaaggaggatccgtatttttcgccgtaatttttgccaaaaattcacacaaactgcgagcgaaaacgatttttccacctttcatagcatcgagtacgcctggttggctcagttggttagagcgttagtctcataatctgaagatcaccagttcgaccctggtaccgggcattcgactttttgctcatagtaagtgaatttttttgatcttcgtgtactgatctgccatcaatctatctttcatttctttaaaagcagtctcgttatttgcgtcgtgattcatttcttttaccgagtgttgtcggtaaaacacggtacagagtatgtacagtcagaacagcaccaggtcgcttctttcgaattccacagttggataatgatcttatggatctgggatattgccaatcggagtatcaaccattgaactattaccttgaaggtgagggtattcgtgctgggaagttccaacctcgaggaccatagagaccgagcgattcgtccttcgtctccactcaatgatagttgctattaacaaagaactggatacaatactgacaagggttacgacccgatacaactatacaaccctcgacattctcgacagtcttgttggagagactccagccgaagaccagctgtttcttggagtctttcacgctgggtctacgaactacttgtagctattggcacattacatggcactgtcctaacccgctgtagacagtttggaattccgagctggtgatctggtgagtatttcatgtatcttcaacgaccctgtgacacagcaggcagtcaaggtatctctaccgaatgggacttggaaagaagtccaacaacaaggataacaagcgacccaagcgcaagtctttcgagcaacagaatcactctgaccagcccgccaagcgagtaacgtccctgctagaggcccctccgatgacgaaaccaaccacgaatttgatgctgacctctaatattgtgttggacaagaacatcattaccatagccatccgacaagactcctgggagctgtgctccgagggtctgtctcaagaacttcactagcgcatggctctctatacccgtataaaagcgtgactttgtcgaaaagctcaagataaacaccactaaggaggaactcaacctcttccagactggggatctggttatcaggcctttggactcatcacttccaagaaacaagactctgaatgcgatcctcgtcactagtgagcgacaaccagtcacgcgattgatgaactcagacgaagcagcaacagacccaatcgatcgagaagtctcaaaaataatcttaccgaatatactctatgaagagaatgcgaagaaagtgtctgaactaggcaatgtggagattcacgatcacgtccattgatccctatgagctgcagtttaatgacgacaaaaagtctgaccatactgacatgataaatcaattttacactagatggtcttcggaatcttatatgattgagggagtttttgcccaatgctcgtaatttgaacatctttttgatctcaagtaatgagccatgggcaaactgttgaataaatcaaagaattgaaataaacagaaattaactgaagggaagtgactctattcaactgaattcctcgtcttttccaataaataatgaaagcgaccatggctgacgatgttttcctgactctagcgtcgataatgcaggtaccagatgagataagaaccttactttacaccaaatttcgggcgcggacagttccactcgccctatgcaagacccccgaggactttgcagcgagcatgaagttacccaagcccggtaagaacgtacacgtgttttcgacagccagagcggagctcgggcccgaatgtttgaaacacagggcgagccatgtggataagaaaaccggggatatatctggggtccaggaaagagtggagccaatatgagacagaggttggacagtgttagcgatgctacaagctgatacgaaaagctagctggataactaacagcgaacaattagccactgcgtgtcgatgttatagcagcactactacttctggactgctacttttactctgctactcctggagccgccttgtccctgctcacacctgactagtgtgataaagagacttgttaaatgggattcgaaaagtcgattccgaatgatattttgtccaattgacgccttcgggaccagtttgtacaggcacagtggatagagcacgtactcacgctcgtactgtattgttcgtactgtatttatagtggagtttccccacctatattcttactgttatttttagtcctggaaatcatctagtcaagtttagaaacatttcgatccaggttccgcaaacggatacttggattttacgacatttagttaaagtattagttagcctagagagtcatcgtaatgaggccatagattggtgcctatagataattaaacgtcatccaaccatctgacggggttcgactctgtttttcaactcgcagaatcagttatctccttactcattacagctaccatgctgactgatacgacaagcaacatcatgatactcatagagtataacatggtaggggcaggcccatttatcaatggtactgtaactctggtatattctttcagtcaatatctatacacttacacatgattgaaatacaactgagcctcttttgttcctcctacttcgggtgtttcaaatctttactgttcaacttattactcgattattttcccacttctagagaaatgtgagtgtgctcagacagtgagtaattatcaaaccgtagaggaaatttgaagaattatgaagaattttatctttccatccgagtcacgtgactcgtttttgttgtacttgtagatgcctatgataatcatgtctctttgttgtcatttcggtttcttcctcaactatctaacttatgttccaactaataatccaactaaaatcccaatattaactaaccagccaaactctccaactaactccaattgcgccaccccgattaacttccactagctgaatctaacgcccgtgtacactttggctagtcctgttgatgctgtttatagtctttttccgctggtagaacttctttctccttaccagcaattatcgtgacctcttctccagcatgccctactacgcagtctacagtggtcgaagaaggggaatttttttcaactggcaggacgccgagaatcaggtgacgggctactcgtaccccggacgtgaccgatgtgcacggctggagggtgccgttcagctaatgaagcagaatggtgccggcaatatggcccgtctggttgactacgatgagatcggctatgagcgagatctggtgtatatcacggcgtgccagggggcagaacctggtcttctgggctctgcggtatttttgggctccggaaaccgctgcaaccacgccaccttgtctccttcaaagactctcagtagggccagactagaggccatcttgcacttctacaaagaagtcatttccaagagctccaagtccgatcctgccaccgctgcatcgtacaaatatgaccattggccgtcgtgggaaatccgcaccgactctcgaagcataatcgaacaggtgtctgaaagtgtgcgacgatggacctttgatgcatggagagagggcgagatggaaaatggcgacttgttgcacgaaattgcagaggaacatggcaagttgcgaaatccggactttgtgattttcagacatgtggaaaattccaccgacggaggttctcatgagtgtgcacagctggcttatggagccaccagagagtgtccgttgtgccatagaccttttgctgtcgctgatatgaagattcttcgtggagaaaggtcataatggagaataaaataaaatcatgacaaaatcatgacaaaatcatcaccaaactccatcaccaaactccatgggcaaaattaatggtctttgacagacacaaccgcaacagaaacttgcagcgtatgagctgagacagtcgtctatattcgagtatgtactgttatgtacaatacaagaactggcatttaaatcacatctcaaagttgttgatccactattcgccgccattgttcatgctcaactgagtctttcacccggctctccctgtactatccgtattaatgaaaatataagaagtaacgaaggatactatgcataatcaggccttatctatgcacctgaacagacgtagatggaacagcgtagacggcggaatttttgtaagataaacatcgagtattgtaaagaactatcacgtggcagaatttcttctttggagctatttctgtgtacttttaccttgtttttctttcgcccaagactttaacgaaggatagcaacaggagcaggtttccacttgttatagaggagtcatggccaaacttatatattacaacgtattcaatttcctttggttagttcatttccgtttacttatttcttatcggggcaattttgggcgagttgaaggtcgtcatatggtggtatcagtatcttagtgatacaaccagagacgacccaaacatagttaggagaacatcaattgaccaggctctatcccatagactagtgtaccagctattacttgttgaattgatcacctcgggagtcttccggtgcaccattccaagttctggactgtgtgttgggtctatatgactgttgtaagtaaataactacttgtaaattccaacaatactggttatcaacagaaaacagactgtcagatgcaatactgatgaagttgccacgatttcttgccgttcccgactcttcagactcaccgatgatgccgagtctcccgccgatgacaacggtcgtcttcatgactctcggcaggaatccatgcacaccaccatgatgatccactcgcggctgttacaggtctcccagaagtccagcatactacttatagcatctaagtcgcttcaagtagacatgatgatccgtcgcagtactcgcacatggaaagagtcaataagagagaccaatggctcgcgaagaaggggtaaatgttgatcacgtgatctttacgcatgttacttgtacttgtaccattccatcattctataagcactgttttcagatctcaaagttgacatgctctctacaggtctaagtgcaggtttgatgaacatgtccaaaaagtcttagaaaacactttcaacaacataagcacaccaatggttgcgattgaagtctgaatccggtccgagttccgcgtaattacatcatatcaactccactgtaacacattacttgggtctaccgccgaattctgacatgttggtctccgaagcttttcacagtttgcagcaagggctcagaacagcatagagagtcattctaggaatctaaagagatgattcagacggaatatatttcgccctatttttcgatgaatatcatggaaaaacgaaatgggccgttttcgggcacaaaacgtcgcctggttggctcagttggttagagcgttagtctcataatctgaagatcaccagttcgaccctggtaccgggcacttgtttctttttgcatcaatagtcagaagggcacacgagtttttttctttcaggtatcaaaaaggagtcaagcaagcttttagtgctttatcgatacatctttgtcgtatctcaacttacaagtacaacctttttagccctcaagtgataggttttctttggcttatcaatcaaatccacgatatagtagtaaacgagggtgttagatatattttaatgtcggaagtggcagtgcatgaaagagagagagagagagagagagagagagagagagagagctattactaaagtgttggtatcaataatggtaccagaacactcatacggggagcttcctatctctaacaacaaaagtccatattcaggcagcaatactgggacaaccaacgacaaatctgttccttaacgcattaaacagagaccactttgtttccaccgttaccgacctcacaccgaacaatgtgatcgaacacctcgaggggctctggaacatgctattgccaacaatacctgatccgaaactcatgtcaatggatcaagtatacttaactagcggctagctacctaattatattactttggtgaggagaaacctcctgcatctcgaaaaaatcaaaaaaggtgttttttttgttctaatgattcattacagctatataactagttagccgggttattggtgttcaataaatcatacacttatgagtcgtttcggtgtgcgctgcgaggcgcgtgtcagttggtttgtcgacgcttcgtctagttcttgtccttgtcgtgattcttgtcgtggtctcgtggtagtgaatcattgctaacagatcaagtaatcgtatcaatcgttccacgtcttatccagactcgatttccgccctaacctaaggaaactgctgagtaatttcgaggttggttcctaacaaaagccaagaaacgcgccgatggtttagtggtaaaatccatcgttgccatcgatgggcccccggttcgattccgggtcggcgcaggttggttacggccatatcctggtgaaaatacggcttcccgtccgatcagccatagtcaagcaccagagagcccagttagtattgtagtgggagaccatacgagaatcctgggtgctgtaatctttttgccgcttcgaccagtccctgggcgtggcgagtgggctgtgcttttgtctcataggctgtgttcttctgccgttatcacttttcatggcgtttaaaagctctcttttaacgtagatgttcttcggcgcgaacaatcagcgagtatgtacttgaacgccgttttatcttgatatgccaggctatggcgattcaatggagttgtgttggtgtaactagttccactgtcgtgtacaacaatctcgtgactgactgtgtcctgatcttctaacattgccaccacttgcagtagtcgtatcggtactcgtacgaactcataggtgcatgtatgatgccaagtgccgtttgacttcttctcaccaccatgactgaagagaagaggaaggagaacgtggatgctcaggacgcatctgacgtcgaggacaacagcgacaccgcctcgagcgacacctacgactcccacgatccagagtcggaatactacgatcctgagaacgggtttcggaaacagccgattgaagaggtgcgccaaaaggttgaggagatggagcagtgttatctagacgcgcaggccgaaatgaaggaactcgcagaaatgatggagaagtacaagtcccttaagtccaagtgcaacaagctgtctgcctaccgggtctaccaggggccgtggagtgtgtacatggaacgaatggagcaggagtttcccaacgagaagtttgagatacacgaggagaacactctgttcaatatcagtcagcagttcgatgagctgaccaacgagcttctgagagagtctgcgttgcaggtgaccaaagatgtgtagctgtagtaatggtcaggaaggagatgtgcacttgacccaaagttgataggatcctctcttcggaatcagttctttcctggctttcagacagagctggaaggaagaagtcgcagcaatgggggtacagtgcctggtctcgtgcttgggcccatcaaattgattgtatagagataattccatttatccggtgtatcgatgagtattttcaggggaaaccgaacaactagactgtcttagagatagaaaaggactacaaataggagaggggatggagataagagaatggttggaagtaagggggcataggaggaaaacaggacgtaaagggaacgtgaacaaccgcaattcacagtctattgtcactgggttgttgtatctgtttatcctatgggttgtagcttaacaacaggtaggccgtatagacatgatgatgtaatggacacccaacttatggtctactttactgtatgttggagtgaatccaatcagattacaagtactgtaccagtacaatatctccaattgaacgctctaagccagtccgtttcaacatttcagagccagtatccagcatctacatgatgtcgcattgtagcactcaccaacaaagtacacttaaaacctatgcctctcaattgcaatttttcaagcgagaagcatctacttttacgacactcgtacttggacatagtaatggatctgtctcaaccatgcttgaacggcggttgatccagacatttagaagactgactgagtatccaacgggcctacttcacctaacgcgactactccatcagtttgtccttgtcccaactcccggaagggcccgttcctcgatgaaacacacttgcagtctgcgtgtcacatctggaaactatctgaaacgcttcaggggaagagattgtattccgtaccagcaatatactaataaacacagacattggcgatattaccctctggaatgtgctgtacagaaggtgttagtttggttacgtccggtatcgtacgaatcgtcatacgagtatgtactgtatatactgtacttgaacaagtgtgatgcactttactcatacaacatcgtagggacagttgtatggaatcatacgaaccacctacaatcaccattacaccgcatggtcttcccattgctgctcgaaaaacagtttgaactcgcccccagctcttctgtcaagacagcacagtctgtttctgcttgtcttgagtccattgtccattgtccatcgtctattgtccctttattatctccttcagactcacgaaacatgttattatataaaaaacacaactggcataacattgactccgtcgcccacgcccataaaaaacgctggagacaatcactctatcgtacagttaacagacggcggtacgagttggtacctccaagagttgtagcccattcccgctcctaaataccccaactccgagcccttccccttctctccagacttatataagccccttttagatcccggttcagatgccgctacttgtagtacgagcgcacttgtacgaaattagaccaaaaaaagctcttttcaaaaaacaacacttacaatatattatctgctccaaacaaagttgggttatttttaaattttgcccctggaatttgtgcgcgtgctgttggcgttttccgaaacgagaaaccctagccgcatcgctgattggtggtggagacgtccaaaacacggccaaaggcagcgaaatcgacctaaacaaacaacaaatcagccgcatatacccccatattaccacgacaacaccatttcgccaccctaccctaaccgccaaacgacagtcggaccacactcactagcagcctaaagttcactcgcacggctgagaggtacgctatacagtgcccagttgaagaacatttgcccgagggttgcttaggctgagaaatcgagacggtggtcacgtgaccgagggctggctccctccgaccacgactcggcaaacgagacagacacagagaggggacaacacgtgacgtctatgagtccacgggccccttcttcccttctcccgtctccgccagtgtattattgtcgacacccgttcgggatacatcaaaataggagtagtgccaaacgttaaaaagtgaaaataaactcagtcgtacacgagcactgtaatacacgaaactatcaccactccaacctccatctacatctcagaaaaaaccgcacgactcggctcaaaaccccccacaaacacacacacaactaatgaggtggtccagtctactactactgggctcgccggcttgggcagcgtacgcggtgcatccggtggagctgccgaaactcaacacggacaatttcggcgagatgggcattctgggcgactatgacggcatttcgcgggtcgaatatggcggtcagcagaacttttcgtcgttctcaggctcgcaggtggcacaaataggccacgactcaccgcacgtgatagcgcaggtcaattcgtctgtgctgattagtctggcccaggtgcaactgacgcgaaaccagaccatcaagcagtgccagcttgacaacaatctatatatgacggacggaaggggcttgtggacggtggacattgccgagggaaccgtcaactcgatcatcacgggcctgaatggtaccatccacgcactcttctgcgatagcaaggagggctcggtgcttgtgggaggagaaatggaaggaggagtggcgcagtgggacacgcagaagcaggattttgcggttcccagctttggaggattcaaaaatgggtctgtcaccggcatcaccagactgggcgacaatctggtattcacaggctcgtttgagggcattgtcaacgacaagggcaccaaccacacggtccagcacaacgtgaccgacatcaccgatcttgatttgaccggtctggcttccaaccagaccactttggaactgctttcaaatggccagaatggttctaactcgtcagaaactctccaggagattgctcgaaaggtgaaccagacaatcaacgcaccccagcagatctccttccaatctgcacagatccaagccgagggaacagcgggcgatgtgaacccgaaggatatttcttgtccaggatccacttcgtgggctcttactcccgacagacagggcacctggcgagccaactttccctactcgttcacaccgtcgacagttgtcattgataatcttccagagtcgtctggaggcggcactgagatgctgcggttcctggcgtttcctctgaacggtatcatgaacctcagttatgtggaccaggacggacagaagaagtactgcgacgctttttgtcctatgccgcaaggaggctcgcgtgagttcacctttgtcaacgatattggcatgaactctttccaactcgatttactatccttctatggtaatcatgctggtctttctggggtgcaaatgttccatgctgagcgattcactttcgctgacaaccagcttaacgaaggtaacgggtgctctaaaaacatgacgcaggccacaaatgccaccgcacagggtgatttcagtacccagggcacttatttgacatcttccatcgactctcaacagcaactggacgacacacaagtgtccttttcaccgaacgcttcctattccggaaactatacagtgcgtcttttcacccctggatgtatccaggacaactcttgtgatgctcgaggtggtgttgatgtcactgtgcagacttctccctctgacagtcactccatgactctcttccagaccaacaacgaggacaagtacgacaccattttttctggccccatcaacgtgacgtctggtttccatccctcagtcattctcaagccttccgcagagggtcccattcctcgaaactttgtggctgaccgtcttcagttcaccatgacgtcggtgtctaacctgacacagatttttggtgactcgtacctcaactacaccttgttgggcggcaagaatggatctcgacttgtgaacagctccgagattgttgacatccgcaacatcttcgagtactcgcctggcaacttttccaccgccaaccagactgttggaaatactactctcaaccgactgggacctctgattaacggtcgactgactttcattgagacttctgaatctgatgacggcgttgttcttgctggtgacttcatttctcctattggaaagaacctgcttcaggtgggcaatgagtcttctctgttccccaactccacctccgccaacaagaccgatattgatggtcccatcaccattctgacatctattgaaggcaccattgttgtcgggacttcgtccggtctgtttcatcttgatggaaatgctcttcgtcggattgacggagttcccggctctgtggatgcgttggtggagtacactttcaacgacaccaggcacgtttgggcagccaccggcaacaactccaatacctctgtgtttttcaactcgacaacgtgggagaaaactgagcttcctgtgtcggcctatcttcgagctggaggcagcagcgatgctgtgactgtttatctcggtatgctttccatgtcgcaggttgaagccaaaggtgccgtttatcttgattctgacttgaatctagttcccgtcgcgaaattaggcaacagctctactttgaccaagagacaacagtccaatgagtccgattctaaccagactgcctcctactacaccggtcactatgtaaacgaatcgactcttgtgcttggaggcagtgatctgacgattctgcaggatggtatcaacgtgggacctaccaactcgcttggctaccctgccaatatcacgtccttggcctcttccaactcgtctaacatgctgtttattggtggtgccttctcttccgacattggatcgactcaggtgattaacctcgccttctatgatctcgacaacaacggctacgcctctctgcagccaccgggactcactggtggcaacgtgactcgccttgagtaccgagcgtcttctcagacgcttgttgcagctggatcgttcggcatggctggttctcttatgtgttcagccttctgcttgtacgatcttgacgctgctcgatggaattctccctcgtcgtccatctccggagtcgtcaactatctcgagtttttgtccaacgatgttcttcttcttggcggaaacatgacgttcgacgaccagacggcctccgtggcacagtttgatttttccaccggcgagttctcgtccatcatagacggcaaccagacagactttgaggccgtgcagattgtcatgacaaacgatgatcttaccaatgtgtatgtggttggcaagagcccgtctggccagaaactcgtgcactggaacggtactgtgtgggacgaggtgtctattcctggtttggaagacacttcgtacatctcatccctacagctgttgcagactgggggtaagaagaagcgagacaatgtggtgacactggatactgatcagctgcttatgatctcaggagacattcagaccaaccagggcaacttttcgtcggtcctgtttgacggacagtcggtactgcccttcttggtgacacaaagtaagtcgggacagggatccattaacggctttttctcacagagctccaggtcatactctcccattcacaagaaaaagaagatgcgacggggttttgtggtgctggtggcgctggccgtggctgtcggtgttatgttcctcatcgtgggcatcggcatcattgctacttgtctgcgtcgacgcaacagtggatacatgttggctcctggccgagtcaacgaggcagaaatgacccagtcggttcctccgcagaatctattcgaggatctccatgggtacaacaacaaccaaaagttttgaaaagttttgatagacgttgaatttatttatacacattgcacacaggcttaaatcgcaaagtgttgcgtattgtagctgctattctgtagatcatcggacgtccgtggatgctctgttaatcacttatgtaatactgtaccctgtagtaatagttgcaattgtcactgaggacttatgatactaatactgatgtgaccgctgctgaattcggacagtctcattcaccagcaaatgaatggaatcattccaagcattgaaggagtctctgtcatgtgtgtggtccttcagctatgttgaactagctgatactcttcgtcatgcccatcttcatagtcttccaccacctttccttctccggtttcttcgacagatcatactctgcccttccaggatcaaccttggtatgtactgtcaacatcttctttagcccctccatcatcttggacgaaaagtaccatgctccaaactcgccgttcgaatagccagcaaatatgtgactggcatcatcggccgtctcgatatcagtaacggtaccattagccaaatcaatgatttcagctcctgcttcggttccgtagcacgtgtaccgctgtgcgtcacgtgatttacttccctgatcgccccaaaaccgaccatctatgccatggatcattcggtctttgcggtagtacatgttggttccgtccaggaacacaggtatataggccaggccctttcctgtgcactttgtaaaccaaacaagcccgttgaaagtggccacagcgtcgatatttgctgacgttgaaaatagatcaaccatgcgtttgtgatacaagtcagccaaacgaaacgttcgcgatgtctgaggagcatcttggtagtaagtcgagatgtaacttgatctgttggagaactctggagattcgtagtacttttggctgtacccaaatccctggccgtctcgaaaatcagttgagacacgtggcaacaaaaaacattctgttcctgaacgagccactatcacagcgtcattcatataaatgttggtcaattcggccatttttgctggtagaaccacagaaatgtccttgtaagtcacttgtaccttgtggccgtccactgagtcgatcctgcccatctcatctctccctggaatgatttcacgagccctcagagaccgtccatcgatagcgtacttgtctttcaaaatgagctcttcattgaccttggagtgatcgcaaccaactaggagacctctgaaatcgctcggaagacgtccatatacctgtatagcaggcaggatccgagcttccgactttttccctggaggggtgtccacctgctcaactgactcgatagccctccatttagagctgcgcaaacgcgccacaaataccagggcacaatctgtccacgtctctagttccgatccggcttctcctggctgaatcacagcatttcgtcccagcaccttgtgtttgacaatctcatcggcctgtttgaaggcctcgttccagaaagagctaacttgccggagatcaacacaggcctcaatctcacaaaatgagaatatggcgagcgcaatctcgagcggaatggcactctcagccatgttttcagtcggttttatcgccatatcaaggtgtcgttgtggggttacatctgcatcatgcattagttgcatattccgatgcatgtcgaaccttgttatggaaatgatcatcgggaaacgaaacacatgaaacacatcgcggcagttatttccacgcaaggtttatgtagtcacgtgcaaatcacatgtgagtgtgtcatcacgtgagaaaaaaaatgtacatttgctgatatattgtgtaataacgcggttccaccagatacccacaagactactttgtggatctaactatagatactgactttggatctgactcttcatttgtgtgtaagagtcatggattagacagcagattctctctggagataataggaatcatctgcatgggtttcagtactggtacttgtagctcgtctatgattagatcaattattactaatatacaatgtttgagtgacccatgaagtagaccctgtctcttctacttcctctccaaaatatccgaattcttggccttttcggcatacttcaaaagctcctctctagggtcctgtcgatacgccttgtcagtggtagcatcaacatgcttctggtcaggggttccccaaacatccagcttattgtctgggtggtgactagcggcctgcttcttgcgcttctggttgtctttgtggaagtcgtcagcaaaggggttgacagttttgagcgacgtggacgatacatcgacggtctgaagaacatcgtcaatgtctcgctttcgatggcctcgctcaagaaccgccagggccccctttgaggacagctcaggggagaacagcatctgtaactgcccattttcgagtcctaggcagatctgattgaggcccgcgtgccaagaaacacatttggcaggtgatcgaagcttgcatttgtagacctcagccaagtcactgctatcaagaatccgtaacgagtcagaaacagcaactatgtacttcgagtctggtgaataggcagtgctggtaacaacttcatcaaggttgttctccagttgaaccttgagatccttggagaggatcttcagagacttgtcggtggtcgtgaccaccaggttggtactattggatgtcaaactggtcacctccacctgtagagtagacatagatctggagtagccattggacttgctataggttatcagagagtccttggtagcagcaacgatgaggccatccaacgctgctagatggtaaaccaccccagaatcgtcaccagcgaccttcttgacccccttggtcttggtcacaatcacatttgtctgcttcagagacccaggagtgtacttccaaatccgcactgtctggtcacgtgaggaggtcacaaactcacagccgcccagtgcgatacccgttagtaccgtcgcagtatgtccctttgtgttctgaggcgtcacgaggtacatgtcaccttccacagactctgccagttcctgtccgtctctactgtagatcttgactttcttcgtctcagaaacggccagaacaatgttgctgggatcatgtgccaggcaagtgacttgggcatcttgatccacctctctgaaaggcttatcaagagtggggaagtcatagaactccgtttttcgtccggtggccagaatcaatctgctgccagacttctcctgaacaaggcacgagactggctgtttcgagatgctcgcaaacaattcatgtgatattggcagttcgtcgagttcgtcgtcgtcatcgtcatcatcgtcgtcatcaccgtcgtcgtcatcgtcgttgtcgtcatcggtttgttggccttttggctgatttcgatgcttgaagtcctcacgaagagcaaggctcagcttgtggtcgagattggacgtctcctgctgttttccaaacgatgtgagctgtgttagagccgttcttgagtagttgctgtgccccttgccactagtactcacctccattgtgtgctcaagatgtttcaacaggccaagtaccaacgttaccatatttgcatgctacatgcacaatcctcttgcacagacgaaagacccgatgactaagcaacttggtctgggggcccacaaacacgtgcttcgagcgttccagaataatacgaatctttctatcaatacccctcacaatcattcaatcgcgtccccccatggccaaaaaatatactctcgcttaatctatctgcatgcataatcgatttttttacatcttaaccatcaccagcaacaatgggcaaagacaccaaagaggccaaagacggtaaagacaagaaggaaaagaaggaaaagtcgatgaaggcccgagagggacgagacaaccaggtgtactcagcctcggggtcgcgggtcgtggctggctgtgtctgtgtcaataatgactcatctcaggtgctcatgatttcgtcggcggcccaccccaacagatggattcttcccaagggaggcgtggagaaggacgaattgagcgtggagggcgatttcagtgagtctgccgtgcgagaaacgtgggaagaggccggagtcacgggcaagatctcaaaatacctcggcaagtacgacgacatgcgaaaacccatcgagtacaaggacagcctgattcccaagacggagttccacttttacgaaatggaggtcgagaacctggcagatgtgtggcccgaaaaccgaaagcgaaagtgggcagggtttgaagaggccaaggctgatctgaccaaggccaaacgtctggagctcatcgaagctttgaaggacagttccctgaagagataggtgagagatctgtctctactactgaaaaatacttgatatttattgcgttcacactacatccaagtatgtactcgtacctacttgtacacttcaacgttatcaccatgtattataacttatgcttgactttttatagaagatgcgagcatctcagattaacgttccagcttgtggagcacgctgcattcgtactccttgtcacgttcgattcgtcttccacagcttatctttctgacctccaaagaagaaccccgaactgttcttcatgttgggactcttggccgggttgggctggaaagtatgtggaatatcctgattagtaatcgtgatgtctccgtcgtcgtcttcgccctcgctgtctgctcccacgtgatgcaaagtgacagagttgaaattctggaaggggtcgtaatcgccctcccgcccgtaacttcgaggtcccgccactgaattggttgatgatcggtcagtgttgaccgacagcaccgacgatatcgacttgtcctgcttcttgtcggtcacaaagtccaccgacgaagaatccttcatggttcggaagttgacagcatcagctccccgactaggaacaggaaccaagggaggcgtttggtttcgtagcagagcccactgtgtgtttttgaagaagggatggttcttgatatcagatgcaccagccttggagcccattcgcttgtgttcatccttgatcagcagctttcgaatcagattcttacacgacgacgaaatggactggtatcccgagccgctgggaaagttgacttcctgtttcagaacgttagagaaggtcaggtttctgttcttgcccttgaagggagtcatgccgaacagcatctcatagatgagaatgcccaaggtccaccaatccaccgcggaagtgtgtccgttaccccgaatgacttcgggagcaatgtactcctcggtgccgacaaacgagttggttctgaagtttgcaatgcacgatttggtgtccaattggggcacgttggtggagctctggatagttggtgcaccaagctgctccgattgcttggacaagtcgaaatcagataacatgatgtggccagactgatgcaacaaaatattctcgggcttgagatcccggtagatgtatcccatcaaatgcaagtactccagagcagcagtcacctcggcagcgtagaactgtgcgtcggcctccgccacacactttcgctcgcgggtctgaagcgctcggaaaaactcacctcccatgcaatactccatacacaggtacaggtagtcattcgactggaaggagtggtagagggtgacgatgaaggggtggttggatgtagcgagaatctcctgctcggcaaatgctcgcttgatcttatttcgcttgatcatctccttcttggatagcaccttcatggcatatagtttggttgacttcttctctttgaccaggtacacctttcccacgtctccccgtcccagcagtcggatcttctcgaacgacgagggccccacctccacatcacaaacctttatcgagttggatgagtaggttcgtgcaaacgactttgagttggttcgagatcgcgactggggggtggctgatccggagcggctgttctggccgtggctgccgtttccgtgattaatgccgtcgttgagaggcgcagagtgggttcggtctctgtcggtaatggggtccgagggatgttgctgctcctcccgcacgaggtcctgcagacgcacatcttccgagccggcaggaataataggcagatgctgttgatggtggccaccggagtgagaatgcgagttggaaatggcattcttgacgttgggttctgaagccacccgtcgaatgttcttacggggatgctgtccgggcacgccgagacctccgtagttgctgctgttgttgttgttgtagttgtagttgttgctattgttgttgggggagggtgaggaaggaggcgagtggaagtttggcgagttgggagaggcggatccgctcatatgcgcaggctgaacgggccactcgtcgaccacggggacaggcttggtggagtccatggggtcgacggcctcgtcctccggggtgtgtgctgccaggtgtttggggtaatgcaacttgggggcaaactcggaagggatgtccggcacggtggggacggagccgtggtgttggttgtgctggtcgggtgtgtttgtgtccttggtggagggggtggagggcgatctaccccgcagaaaccgctgtttgaacgacgatttggtctccttgtcgtcaggcggaggcgaggtgttggacgcgcccgggacgccctggacatggatcgtgggcgtggggtcgtatttggggaatgcaatttcttcgtcggggccgttgcccgagttggccacggggctgtttgtgttgttgaacttgaagaagctcttgagccgttgggggaacgtgatctctttgcccgagtctttggcggtcgtggtgtcgtctcccggacctagagtgagggctgccgacgccgacgtcgaccggtttcgcttaaacacgtcgtctaccatctttgtgggttggttggtgtgaattagatgggctgtgcagagcggttggatgtttgtggaaccttgtgtctgggtgctgtgtctgtttcctggtcgtctgtgtgtacgtggtcgtctggggtcacttgtctgggctggtggagtcttcctttgccgccactctcacaaatgcaataagtcaaagtgcagtcaagtcaagtcaaggccagtagtcgaggcgagtcagctggctgtcggtgtgtacagagtctatgtgctgtctctgcgaagctagctaaggctaatatgcgggtctccgctaaatgtcgcaagcccaaaaggaaggttgagaggggacgatggggacccgcgagcggtggctggctggggcgggtttggacatgagcggactcgccagagccaggcggttaaatccgtgcaactatctcgccaatccgccctcaacacgtcctccgggaccctccatcgtcccccaagaccggagttaacacgcgttatttcggaaacccaaaccctacgcccggtctcaccctcgtttattgcgttaatctgggctccgagaatgggtttcgggacaagctcagtgtgcacgagcttctgcttgggacggcgtttgagacgtacctgggttatgtaagccgccatctccggagccacacctccgtcacgtctctttttcgtgttcccgtgccgccctgatgccgtttcgggctcacaaccacgagcttctttttcttgtattgatgtctcacatacagtagactattggattgtagctactgtagctacttgtagccatcatgcctggtctgggaagtgctacttgtagtagcttgattcggtagactgaacacgtgacccaactacatgtaatcccttgtgtgctctcgtactcgtatcgtcctttaagcgacaaataataactgtctccgcgcacgcaaagtcactcagcactcgatgcagtgtgtcgccctcaacgctggaacaccgcggaagcttgctagcaaagcgcacggcgttaaactgtgggtttaagcatgttataaatgcgtctttttggggacacgccgatgaatggtggctctttgggagaggcgagcctgctacacacatcgttggcggactgcaaagtcacttttgccaaggactctttcggaactttacttaccaagtggtactcgtactgcttagtcaacgtcaagacctctccaacgttgacaaacattgacctgacaaaattagctccaatgcccactgtagatcggggtggcatgacttttggcagatgcaatagacacacagatgtctttctgaccggaccttcccgccagtcgccggtgccgagctccatatcgccaccccaaacgggcttccatttctctgttgtctcctgttcgaggcccccacaaatcaccctcgcttttatcgccaactttatacggtgcccatctcccaaaagaggttgtcattcccaggtcaaccggcacctcggaagcggaccgtgtacgtttggggcgattgtgtgggatgaagagtggtgatctgcgctgaagagatggctacagtagaagaatacagctcgacgtgactggggttgtgttctgtagtcttgcgctgctcttaatcaactgatgtcctagtcgatctcccactacagctaaaatgatgtccatgtgctggtcgtctgagagagcaagagcctgagagacgcgcttttccagacattccacagcgcgtttctcatttccccatttttcgcatctgagaggctatccgaacaaaatctggaaagctggaccctgtacccaagccgtcgagctatacttgaatggggagaattatcagagaaggcagcattcaagtcgtgctcggtatgcggtcgccagttgcagtacacctttgcgaaatcaaactggaaccggaagtcactgctgaccaatgacgttttgttgactgggtctgcaacgcatcatggacgtctttcatgtgatcgagacatggaattttggttgaggaaagcaatcgagtccaaagagactgcttgtatacatattgcaattgttgacggaccattctcccactctccaactatcccactataccgacctggtatcgccagcgaagatgcgcatcaccgtcgagtttctacaagatctgtttactgtacagtacgaatggtattcaagcacagtgacatactactgcgattcctgtggtatttgtacaagtacttcaggctcttgggaagctactcgttgatatcttgattgatacaagtacctactgtacataccttttgatagccctcattgaggtggttagtgcaattctcatagcccctgagggagctgatagacgctttaactgacttgagataccaaggaatgtttccacgagaggtgggggatacaacaagtactgtactgtactgagaacattgttgcgctgtgaattaacctcgaaattaacctgcaaatatcgtcttctgtacagaaggagaacttattccgactgaaaccaccccgctatccactgttaactaccaatctaagtagatactataattctacttatcctttcattaattactcaactataaacacggcctacatactaagggcaacccagcacttggtgatcgtccctggcatacaggttagatttggacaggtgaataataatgaaatctccattcaggtggcaaataacgtcatcagattgccatagcttcaattacctacgaaaaccccatccatgacgagacccaatttttgtttgttcacagaatactcttagtagcaaaacagcacatgggcacaactgccttctgcaccaactggtcaaatatacatagtcaaacaggcaaaggagtcgggactctctccctgcattgtcgagctggtctcagttagacgactgactgcaaaaacaaaagtactgtagcggccaatggaagggcccgggcacgatgtgtggcctgcctttgtcaaggaacgtcacgtgaggaatgtctttgtcgagacacgtcacgtgaggaagccctttgtcaaggcatgcgacttgaggactgctcttgagtcgactgaacttgggttgacggccctgcgtcggcaggtcctgttccgactgtgcgacccgctgctgtctggctttgtcctattctgtccctttcaagcgagctgacatagcatccttgatacagactgacctacccggatcactcgagtacactctgattctcttggtcttgcttctcacgacagaattctctatatcccgctttttgaacttcttgcagaagatacaaatcgcccgccatctcatcgatcatctcagcaaatgcttcagattatggctgaggaagtctcgcataaccggggttatgctgtggatccagttctgaagggcggtaccacttctaggtggattgaccatgggtggatacaattctttgcagaaaccctgctcaagacactgtcgaatttcgggtgcgcgctggaaaagttgtggagcgcctgcagcgagccaagtgtgtctgtctccagagagtccctgtcttgagatggggaagcaccctgaaaatcgtcgtcatctgaatcatcagatgtcgatatggggtagttggctctgcgggacattcctcgtgtgcctcggtcaattttctattgtagagaaggctgacattccgcttgagaaccgtctcctggtattgggccctcggcctttcaacccagccaggtcggagagcgccattttccttaagtagtgaaattctgtatgaaaagataggatgaggaacaccccattggcggccagcttccctgtgaatggagccggtcctgatcacctccaagcaggttttggagaggttctctggcggtactgcttcctcttcttcgatgctcggtttctgagcatggtaggctgtggtcaagatagctcaaacggacgtattgattgtaccaagtcgctacagtaagtactgtacagcaccggtggctacttgtagttggccaacttctttatcgcatggaaaagtcacagttgatgtgttcggctgagggtgccatgtggcttactaatgagttcatcttgactaatagtcacccccaaagactcgttgagcaattgaattacttgtaactgttgcgaagctggtggggataatgaaatgtcgtatctttggaaacagtctctactacactcgatctaagtaggcgtctcagccaatcaagttggtcgtctcagcttaataagagcgtggaggttggccatttcgtacatctgaggtgctttttttttgtatcgactggacattccatggatccagccactgttatatatactctatgttctctctaccattgtcctcacatcactgttcatcttcactctgcatactgtactgtacttgcttatcaccacctgcaccgtcctgcacctagttgtacacctcctgcacctacacatgttgaccgacgcaacatgagatagcacagccaacgacatgttctcaataacgaatctgaaagttgacgaaaccgttcttaaccggccacaggcgcaggagattgacctggagtccttctgcgtactgggatcaagtttcaacgaaattaagcgcgaaaacgacgcgtcaccaacatccgacatcgagcatcagacccagaaaaagctgaaacgacacacgcaggcccccacgcctttattactgtgcgaacatgaccagcagaccatctccacgctgtttgaaggcgccaccatcccaaccagcctgtttctaacatgtctagtcaacgtgctggtgggacgagaatcgatcatgttcatctggagatggagctcgagaagatttgtgtccaaacactttgcacagcctatcaaagtgcccggagtctccacaatggctcttcagggactggtcgaccaatgcctggagattgggtctctgttcactcgtctgtccaacacagccaaagatatcgccaaaatggtctcgttggaagacagcattatgattgcgttcaggtccgctctcaccgacattctggctgctattcagcattacattgagagtctggatgccagtgacgagtctcttttcccgctactagtccacctgagacctgtttctactgtcgtacatctgctggcaaatatccttggctgtggagatctttcacgagctttgtctcttcagagccttcccaaccccgtaaaattgctttctgagcttcatacacggctttccatctatcaaacatcggatatcaacctgtatatcctgaccgctgagttgttcaagcggtgtttgagcccttggatgttcaagttacatggagtcattgggttgaacggttccacgtactggaaaaccccgtccaaaatggtggatccagagatgtttgttgttcaagaaccaaattcgggctttttgatcaccgacaaggaccgtttaccgacgtttgtatgtcccgaagacgcccaaatctgtgtggagattctcacggctttgcatatcctttattctctaggagacaccactgttgttgatacgaacgttgattccaagccggttatgcctcaggtagagtctcaagaaacactcatacccccattggattttgaatcaagtctcgaaagggatacaacgagtctcctagcgcccgctcagctgttcacagatacgctgtcattcctgaagctcgagaaagctgaatcaatttccctgtttgagtcagatgaccccctgaaggacttccaggtatcgattgagcaacagcagcaagcggtcaatgactcactcatgtctcacgtcaagaagtacctcttcactcatttagaaagtgctaagcgattcttcctgatggggttgggagccatagatctctgtcaactcgtctttcaagacaacactgtcaaaattggatcttccttgaactggcctcctctgaactcggatctgcgaatcacagaagatttggttgcggacctgcttccagacaaagacatcagaatatggtttggaactcctcagaacattgatggtggtgaggagtctttcgctcccgactcaatcatggcgacagagtatattacagtcttctacactccacccgaggaactcaagtacatcttcatgccacacatcattaaaggctatcaacgcatcttcgcgcgtcttttgaaactcgcccgatgtgtctactttctccagttgaaacacagattcagtttccacttcctcatccagctgcaatactgccattttcagatcattgatgttgagtggtacaggtttcacaccggaatccacaaaacgtccaacttcatgcgaattgtcaatctgcatcacgccttcattgatgctgttgaacgcaacctgtccctggtttctcaggaagaccagctgctgaacaactatctacagagtctgctgaatgacgatcctgtagatgttcccaaacattggaagaagttctccgccttagcatagtatttatatatttattccgacgcttgataagtgacataatggtagatgtttgagtcgcatggatattgtttatgtgtgtgattcaccgtaatagagacgttttaatgacatgagaagctcccataatttcagttactcatttaccacgtatcattattgtttctcacgtgatcgtctcaatatttcagcaagatttctagttttcgccgtgttctgtttttattctgatgagttgagcatgactaagcacgcttccggttttgtagacgaaggtcaaaaataaatcataatttgagggcgtctggtgtagttggttatcacatgcgcttagcatgcgcgaggtccccggttcgattccggtgtcgtccattttttaaatctttgtatttcgattattttttgtaaacgaacgatgattaaaggaatgatttgttgatatgaattatttaaaatgcattcatagttgccgccgctcctacaccacgactgatcctctctattggccctcatacaaaagttgtctcgctctctggttgttgagatcagtctggaactctgccagttcctccggtaaaagatcgggacacaaataggccgtagcttggtgtccaacgtgttccaggaagtaacatgagcagtaatctcggatgacctggttgtcagcttgtttggcggtctgccaggaaattatacacctgtcgccttccaaagatgaacctgtgatagctcgttccacagcccgttccagatcttgtaggaagtataccttggccggaatcagaagctccagagccagttcttcggatacgttggttactgttccatagagaaagccgatgatgatgtctaggatgttggaggggtattggagtttgagggttcgatcacgagactccgtcatgccgctctccagcactgtagccaggtagggccatagcggtatgaggacttgggtatgaatgaggtgtgttttgtcatcttcgtcgatgatcttgaaatcagccagttgcggatgtttgtaaatctcttgaagtgcctttgtaccgtagctgattggtgcaggcacgtctggggctcgtgtaaggtgtggttggacattgcccttgtctggtacctggagagtgtaagggtgcccggctatgacaagtatcacgcttttggtgtcttgttggaccatgtggaagtcgagccagttcgactcccgctcgtaccaccacttgttggagtagttagcactgaagaagcgctttcctccgggaaaaaactcggttccaaacttcttggcagagtagttccacacccgggcgtggccctgcttgtcggtgacagtcagctcaatgttcttgtatgtgcattggtctatcgatagcgagccaatgtccttcagcttgagcattcgctgcttgagaggcagtcggtcggtagtcatggggtggtgataatgagacaacgctttgggtttggtgagcgctggagtatgttgtggctagtgtggtgtcacctcttcaagagcttggacaattgcattaattgctggtgcaaattggcaattgtgtcgaactaaattgatttctgggtttttattcgcttttcggcaatgcagaatgacaatcagcactggcagcttcagtggcggcgaatgggagacttagttgagtttttgttagatgtacttatgatttacttgagagtcttctaacatgtcaagacaagtgccgaattggtacaagtactatacgagttttaggaaggccatgttgtcaagggttctgtggttgtctgaagatgtacttgtccaggtacttgtacttctgcttgtacttgtacctgtacttgtacaaatggggccaatatcggaaatatttggctcatcactcactctcttatccacaggcagtttagtgtgcatatcaccaagagattgacaatggacatgtgagataaatccaatgtgcaagagaaacccaagaaaaccaagagataaaagtacgagctcttcaacctgtggaaactgctcttgaccgccaaatcgccctctttatgatctctttggactaaaagaaacaccaaaattttacgtttggatcaaaagtttccacttcaaagtaattcttcacagttgactttagttgggactttttgttaaagaatgggttgtcgaaaacctccgtagagaagacgaaagacgacacgaagtgtacacaaggtacacaaggacacattacggaaccaaacaaagatacccaaatgcagattactccacttctgactccatttcaccccagatcaacaagtcagatcaaaaaaagtcccaattgatagcctgtagctattggtgctggtaaaagtacctccgatctccacctctctcaaactacatatatggacggtttctgaacatcgaaaagcgcttcagagatggaacgtcgtcgacgctcccctcgacccctcgacctccctctctttccatctcatccgttccaaaaatatgccactgtcagaagctaatttctggtgcaaactttcggatgtgaaaattcacacacttctgcattaacgagcacccatccactcgtcatggcaaccaaattctacgccgtcagggagggctaccagcccggcatctacaagacatgggacgaatgcctggttcaggttaagggatatccggccgcagcgtgcaagagtttcgcaaacagaaccgatgcggaggatttcatgaatggcaagaagtttccttccaaaaaggagctaaggaggccaaaaagaatggccgtacgccatcaaccaagcccaaccgacccaagggatctactgcccatgctttagacagagacaccggccgggtggttatctatgtgtctggagcctgtcgtgacaaccagacatcgtctattgcgtctgctggcactggtctgtttgcaggtgttgaacatcccgacaaccagtccaagcctttgcctggataccagcattccaacaaccgggctgctctcgtggctctcttggaggcgtacaagctgatccggctgcgtaacgacggcctgaagtacgagatcagaaccgtcagcctgattgccattaacagcacgactgtgtggtgtcgaggatggatgaaaaatggctggaagaacgccaagcgaaagcccgtcgccaatgctgacattgttcaggagattctgaagcagaacactgccatgcctggaaacgacaagatcactctgaagcatattctcaagtctgagcaggataagggcataatagcgtccaagctgctggcaaagaagggagtacgaagctgcagagacgtgcagtgttcgtgcggccagatgttgactcatgcgcattagtgatgaggatgatatgaggaggagtgtgtgatgaaggagctccaacgtgaaagtcgtgggaaaaccactcacgtgaggtgaatcggttcaggaagtcagagatatgttgaaggagaagggggttggaactagggatcgtgttggaagtccatacgaatgatgcatgatggaggtgaggattgaacttgaaatgacattgcatggtatgtacagtaacttgtaggtttttttgaaggtgatggttttattggaaacttttctaataatttatgttcctcatcaatagaaaacaacgtaaaggaataatcaaactacatcaacaaaggttgataaaagatgaattaaaatatgattactttttagataaaatggaatattaatttattatttatcaaattaaataataaatacattattatttatcaaatttaatacgttaggtatatcattcgattttatttggattgatcttgacacaggtacaaataatgacagaaaacggccatgaatacatttattcgacaaaatctgcaattatctggcgagccgtttaccttggtacaagtacgagttacgataccaagatttggcgatatcatcactttctgtagcaacactcgactcacctaccgtagaaaacccgcctcacaaaatcgccccaaaaacttcagcaacatgaggccaaacaaatgatacagagacagagacatgacacgtcgactggcgtttaatgccaaatatcgtgaatataaggaggagcagatccgcaactttcctcttacttcgacacaacaattattcacacaaaaaatggccgttccacgcactcctggaacctactcttctgccgtcagtatcccgccgctactgagatgccaagtctgcttgggctcttttcctcctcacatctttgacaagcacattccctactgccatgagtttcagcgacaaattctcaaggattattgattgatagaggtatagatttattgacgcatggaaaatacaaaaaaaggaaaaaaacagatgaaaaaaattcagacgacctcggagagggtcgaactctcgatcttacgatggcggccatttaggtgactaacagtcgtacgccttaaccaacttggccacgaagtctgaacttaatgttaaaaattcgaattttatatatattgaggttattcgattagtcagcgctgaatcatcccgaataaaaatgactcattagcattgaagaaaagcaattttttgtttaatttcaggtatatacgaaacgaaataataaaaccctgttcactattccaaaatccagcagtttacttcctgacccagatcaagagttgtgcctagacttgactctggcatgcgataggtatagtacaccttcctgagccactctggcccatataacgtcattatcaatgcatggatattactacaatactataaattaatcaaaacgtcctcgtaaccaaactaaaagtcgtcatcgtcaggttcatcttccttgacaccctccaggaccttgactagggtcatgacgcaaacctccaggttcaccaccagatactcggattgtcaggaggcagcgatttcttctcgcgggcgtggaggacccataatgacgctcatatctgtcgccccaatggcccctagaccagtatcagtcatggcagaccatccactgttgatcatgttgtcaattctcatctcctgatggtccaaccaagccttggagaaggaccaacagtgaacttggccagcaatgactccaaacacagagatgggcttaacagacataacagatagcgtttctgtgtccaggaaccggttgcgggtcttgatatatcttccagtcataatgtcgctcgtggcatgcgaaaagagatccttttgagggccgtccccacacacgtttcgaatgtacatggccgaggcattttttgtgtcgagataccactcttggatgcttgtgttttcgctcatgtcgtcttcctccgtcacagtgagccacaacagtcccttgacgacagccacacaggtcacatggcccgtgggtcctcccttgatgattctgcatgtcatttgttcgtagtcacacagcagaagcatttccagtttgaatctccaaacgcgcacgagcgagaaccgatcacacaattgcgccactctcaagttgtcgatatctgtcaagcatctgggcagcttgagatccgtaattttacctctaccgactcttcggagagctagaggggttccatctcgtcccgtgagctggtaactgagtctctgatcagcaatatcaaagaccagaacgggagcttggcgtgaggacgccagaaagtcccgatcagggttcatgtggaagtactccgtcttctgtagcacgtggggaagtcttaacagtgtgtttgcggggattgtgttttcaacatggacacctccggtaatgagattaagggagaaaacgacatgtgtttgtcgttcgccaacacccacagtcttgcaccatctgagtctcaagccctcagaggcccatctgttgagaggagcggcatccgagtctttaaacagctgtttgatgtttgtgtccaacggcaggtactggtcgtgatgctggacaatgtccacatgttccgagagtgtttttgtcggcgtggggacgtccattgtctgtctgaaggctctggattttctgattgcggtctcaaccctcagcttggccgctgaaagatgatctggtcggccctcaagatgtgggttttgcagcgggaacaaatgtgtcgagagccccgagtagtgttcgcgactgtcaaccagggcagcgtggagatagcggctggtgcgcatcaggttgagaatctcctgggggttgtccagtcccacgtagtatgcgatttggtgtatgatttcgagcggcagagcaagcattggagaggcgtggggctgtaaggggctgtgggcaggctgttaagtatgagtcgtatgcccctggttactgccagtttctggggttggtggaaaatatggggatggagaaggtgggacggaaagaggaagctgggagggttgtgcagatggggatcggagagaatcgcggggacaagtcgtattgagatgaaagtttgatcgttcgatagctacaaagtcgactagtccgaatttaaggccacaatgacttatttgttttggcatcgatttattggcgatgtgtctgcaccgcacccataagcttcaggacctcattagtgtgcagcaaccatgtgtgatagcgtgatctgcgcatggctggcgggaggcgagcaatcgggcagggtaaccgcagttgatgggggaaagattgcggtggaaacgaaggcaccggtctttaaactaccgtggaggacccgtcttcaagaggaagttgctgccaaagttgctgccaaaggccccacctgacaataagcgtcagctgacgggatttacagaaaatgtggagctacttgtagatagaggttgagtgggctaatatctaatatatgacgccttagtgttggtggagtgggggcaattggagcgaatgggtggtgtaaaatggggaaattccgaatgaaaggtaaaagtaatgaataacactggttttggggaccttttggtggcgctattttgcatctaccgccgctttggatgcttcctaaattgttggcgattttactcgatttttccctaacaattccctttccgtcaaagttcaattagtcccaattaggcgcgaggatgacgtcatttgggtgagatttacgacggtgaggaagagatacaaatggtcgaatgtttgaacaagatgtaaagtacgagtacgagtacgggtacgatactggactatcaggggtgtactttgtagttggcggttaacaggatgcgccagcgatctggaagctgctgtagaatggggaaagtagcttggaggtgactggggctgtatagaggcattaaagacactggagcactggagcactggaggcattagcggtattaatgctcgttagaatcacgtccgtcttgaatatcttcagtgcaggttagatcctttgcctttccctctctttccctctgctacttcgcggttatggactccttccgtcgtttgcgcgaccccaacgtctttaacagtatcgctcaatgtcctccattgccttgaccaaggcccgcgacttgatgttcatcaaatcaatccaacagagcaagggagtgagcagggactcaaacttctccaccagaagctgcagagacgggttcggcacagatctcgacataggaacgcgagagttgaacaggttcccacagcatcaattcgaatcggatcatcttcttgaatcccgagccgaaatggtcgaaaccgttatctgagctgcgctcgctgtaaaagagaacttgttaagcgtcacgggatcgtcatttgtttttcgtggctttctttgaacgaaccgctaggcttggtgggagtaggcttattcaaatccagcatctcgtccttggtcgctttcattcgacgtttaatcattcagcccgttgaaactgcatgataagtggagaaggaggagcagaatgtcagagtagcagaatgtgagagtagcaaaatgtcagagtaaccgcagaagttgacatatattatgaacagggtcactcagaatctcgactaaagtcccgcggaacgcaacaccattggaaagcgacttctccttgagaataggtagactagggcgagggaatctgaccagagactcagtattcaaaagttccgcaattaaagaagatacgaaatgggattggggagagctctctatcgatatgtccgacatatggtcgccatggatggtattcactggatatatcttctcttctgtaccttctgtgttctctctccactgcccacgtgatacggcacttcccttacaatcacctatatttcaacttcatctccggacctgcatatctgcaacttcgtagactccaaaaggcttataccgtcaaaaacgcagatattaccgtgacaccataccaatattgttcaaccgatgaaatcccctcgaaaacgtgatcattttggtaccacatgagccccaccagtctcattaaaaacagccccttgcgtgggttccgttcgccttatgaggctgacatgtatctcagcacagccgtcccaaggtgatttggacctacagtagttacactgtaccaaagcgaccaccagaaagggcttttgccgacttctgaagtccaaagcgaggtctagcgaggtttaaatcggccccaacacggttgcaaaacactttaaacccgctcttaatcgctggtgtccttttttctccctctcttatactcctgtcgatgctgtatctgggtctgagacagcctatctcggctgatatcagatggaggaactttaggacgaggttgcatgagggggattcattggccaaaaggaggagtttataacttttttaaaaatatataaaaattaaaatatgaacgaaaacatcgctctcaatttatgggaaatttttgtgatttaatacaaaatgttttcccgccattagaacccccacctctccccgctaataaagttagattaacgccaccgctgcatattcgacgtgctaacattgctgatgagcctctttttctcctcctccacaacaacacatcacatcacactccacaccatgaaactgtccattctgcctttgatcgccctcgccacggccgtggtcgcctcgcccgcgcccgatgcaaactccatgaagctcatgaaccaggccaaggacttcggcatgtcggttgcccagggaggactcaaggacattgcaaagaccctggacgacgaagacatccccggagactcgcccatctcgctgtgcgacgccgaatacgagcagctgctggaaatcaaacacctgtccatcgaccccaaccccccggccaagggccagaacctcaccatcgaggcgtccggatacctctacgaggacgttgaggagggcgcctacatcgaggtcgaggtgcgatacggctacatccggctcatcagccagactctggacctgtgcgagcagtccgaacaggtcgactggtcctgccccattaaggccggcgacctcaagctcaacaagcaaattgagctgcccaacgagattcctcccggaaagtacgttgccgtcgcccgagcctacaccgttgatgacgatctcatcacctgtcttcttaccactgttaccttccctgcttctttgtaggtcgaatgataacagcatagtatggcgtcccccctcagtaccgcgcacaactaactgcatataattgatgaatgatgactattttagagtgggggagaagctagccaagagtccagggctgttgagaatcttggagacaaactgtgctatggcaaacggtactgtagacatgttcacacgggcagcatgaaagcttaccagctagctgaggttatctacaggtgcaagtatcgtatgtacttgtagttggttgctacatagttgggtatgttttaatactgatatcgaaacattcatagtagttattcggtctgaaaaaacaacagcttgattgagcatggaactcgatcttcctagaagttggaagagacgccagcatacacagatggtagatctaccctacacttcgatgagtttcagaccattcgcgagaactattcagtttactcactttctacaagtacacccactgactcgaacccggacccgccaaagaacaaccgacaaggctgtatctagatttaaaacactatctgcaagcggatttcgacaagcggatttatccaacatggagctcttcccatgtttgatggtcgtgccccggtcgtgccccgagtcgcatgccaggtatgttgcccgtagctacctgtacactcattgaatagacctctaccagacatgttgaaaccataagcactcacgatctacgctcatgtgcctgcgttcttcatatctgctcaataattgctcaaccgtctcagatacctacattatctgtctgcgttatctcaacctttaggtcgattagatatttgctcatgcaacggcgatggtattctaactgtaaggttgctgtctacagactgaggagtactcatcaggggtgtgtatatatcatatgttcatatttatcatgcaccggagttcggtgttgtgtcacaagtactcaaaatataaaaaagtaccagtggttggtcatgtctgcattcagcatggtcgagtccttgatcccacttaagaagtgctggcaagaagaggagcgtcagagtccacagactctcggttctcggccgcggtgttggccgagttgggcatgctgttggtgccgtactgggagctcttgttagtgccctggccctcaacgttcatatcagcggagtaaacagccgaggctcgctggaagagtcggtcctcgtcgtcgttctgaggaagtcgagtaaacttcttggactgccacgctcgagggtacagggggttgtagccagtcttctccttgaccaaagacacgtagacggccacaatgatgaagatccagtaaaagttgtaggagatgacagagccgtaggtggccgagttggtccatccaaacagcgcgttggcaatcatccatcctccatcggtctgaccgttgcagcagttgacgtgccacacggacttggtgatgtcgtaggagccgggtccagagccggtctcagatacgtccataccaactctgttaacgaactgctgcagctccaggaaccacactccacgggagaaaagaccggcggccaccaggtacaggaagcacgtggagccaatgaggaagtagttgatggagatggcgttgccatacttgtacatggcgtaaccaatgaaagcaccaagggcaatggcggtgatgacgggaagggggaaagcagagaaaggctggttgacaccgataccgccgaggaaaaccacggcctccattccctctcgaagggtggtcacaaacggtaggatggccagagcgtactttcgagacaggtacttgaggccccagccgccgtggccctcgtgggtctcgaccagaatcttggcaatcttgtgtcgccacttttctcgcatcttgttgattcgcagcatggcggctcccatgatggtgataatgatggacgagacaatggagaagacgccctcccacacgttctcagtcatgccccacagatcgtgtccgtagatgtaaaaggtggcaatgaacgcacctcccacggccagacagatgagcagaccgaagattccacccagccatacctgggtaacaagccgtcgatacacttgcaagtccttctgggacacattatcgcccagaccctggttgaggaacgccagaagcacggagatgataatcgccgtctcaatggtctctcggaagatgatgaagaagacctgaaccgagaaataattctcgaaaaagtccgcgtagttgaccatgttgtgttgtggagtacaacctggaaagagtgagtctggtaattaaaagcgacttttcaaaataagctccgtaggggttagagttgggcggcgtggtggtggacatttatcaaggggcaatcgggggttataggggcggaatttgaacgcaaaaaacagatcatcccactactaacgcgacaataaatagattcaaaacatctcccgttcaatttggccgtccctatagctctttaaacgcctctcttatctgatgttgctccatctgataactgcacaacctaattatccggagcctatttttctgcgtataaccgtaacggaggaaacaacaaaacggtggcaacagctcccagaatcgtcgcaaaccgggaagtaaaaggcgaaaattcctcacagtcacgtgagaagtttgtgcccgtcacatgatgtccagggttccgtcttgggttcctggtaccctgttatttcgccatcccatcactccgccaccccacacacccataacccttgactagcacggctcattaacaaaaaggcaaaagggaagcatcgtcacgttgcggctaattggaagtgtatggaggaatcaatttagagaagtttggcgcagtccgatcaaagcacaagtggcatagaacgactcctcagaacgagccaatcaaaaacggtatgtttttctcccacattggactcttattaagcaactagaactccaccgaaactgattcggagcgaatctaccttgcacctgagttccgttataaagtggaatgttcatctccgacaacagaactcacacaacttgcccaattgagctccgattgggccgccagaaatttcagtacatctgctgtccctcgctgaccatttctatatataaatattgccattgtaccccgtcaaaacagacacagactagaactaggcattgccaaagtttacagcaataccctgcactcttgcaacagaacatacactaaacatgcgcgacaatggtttagaacggcgctcggggtttctcctttcctttttatccgcattagtcacgtgcggccaagactttccaccctcaactgcatactatctgcgtccccgttagccactttgagtgcaactacggtgggtctgtttagtccagatcgtcttctcaacagggttgtattttgtagttagttgcaaggaggtaaaagactataaacccgaaagaccttgtttgtgaatgcgaatccacgtgagttcacgtggttggcacgtggctgtatgcctacgactgttctggtcaggctgtcacttgtgcattctttttttttcctttcttttgtcgagttcgttagcaacatgcactcggagtccgagcggagctacaagcactcaccaaggaaccacaagccacagtggcgcagccgaatgagacacggcgcaccgatcagataacgtcatctgataagaggggaagagcttgttcgtcagtgccgtgtagtttcagggccgtttggagtgtcatacgttgaaaactgtagtgcataaaagacagtcgttgtgtcaaggctaatcctctttagttgaatgtttgttaggaaagggtgttctgtgataccgcaagttataattttttaacatatatttcagaaatactaggggaatttcaagcctgaaatgacaaagaaagtgttcagattgtagaactgaatgaacagaacgaattgggaccatcttttccattcatttgtacacacccactcgatccagcagaaccgattgggaatgccacactcagacaattagttaagattagttggaatcaagcgcacttatttgttatgttttttattaacggagggatctctcagagaactcattgatctaactaaggcaatatgaacaagacaaattgtcataaagagaccattccaaaccacaccatatcctctatcattcccctgggactcttcctacgcatcctacgacgtggtttggttctccctattctgctcaccatctagccctaacctccatgcatctcaatgcacgtttaaaaattatttttccaggctgaatatttccgtacacactcacaccatggctatcaaacagaatgcgaaaaagggcggcaagcctggcaagccaggtggaaagcctcctggtgggggcaagcctgctggcggcaagaaggtgtttcgaaaaatcaaaaacggctttgtggagcctcgaaaagcgaaagcggccaagggtacgactgtggcagccatggacattgtttctgctgctgatctgagtgccagcgagagcgaagacgaaaacaagttgaaggatttcgccaagtttgacgatgatgaagaggagaaggaagacaagggtggcaaggccgagaaggacgtcaagaaggatgtccagaaggacgtcaagaaggatgtccagaaggatgtccagaaggatgtcaagaagagtgtcaagaaggatgtccagaaggctggcaagaaggatacccaaaaggatgtcaagaaggctgatgctaaaactaacagcgccattgagggtttcgcacaagccactaaaggtgaagaggctgaggtctctgtgcctgcgaaggaagttaacaaggctgccaagaaggaggacaaggatgtgaaaaaggacactaagacaaaggatactgtcaagactaaggtcaaggctgctgttttacccgaatctgacgcagaaatggacaactggtcagatgccgagttttcagacggtggggaaaccatcgatcttcctgcacccggaacaaagcctctcgacattaacaaaatgaactggaagaaggttgagctaggcgacaagaagatggactttgagggtttctacggacttgaagagctggacggtgttgatattgtggtcaacaacggccttcctacttttgttgtaggggagaagcctgagaagaagaactctaagaaagagaccaagaaggccgaagttaagaaggataagtctggggatgcctctgagccagccaagaagaaggccaaggttgccaaggacggaaaggacggcaaggaggttgccaagactcaacctaaacagaacagcaagaaaaaggccgagggaaacgcatttgaggccctcaatagtgtgcccgacgacattcatctccctgactggactctcaacggcgagcagcttaactactccctcatccagggcctgtatgctcttggctacaagtctcctacagaaattcagaagaagtcgatcccacccattctggcgggtgatgacgtgattggaaaggccagtaccggtagtggtaagacgctggcgtacggtctgccgattttgcatcgatttttggaggctgagaagtcagacaagaaggaggaggtcgaggaggaggtccctgagaagtgtactaccaaacccagacctaagaaggtgaccaagatgaccggacaggaagaaaagaaggacgacgaggaagaggaagagcgattcgatatgtacgatgaggctcccgagccccgctttgatatttccgaccgacctgctgaccttcctgtgcttgacaaggagcgagaagaccgagaaaacgaggtggagatggacgaagagaccgaaaaggtggagagagacatgtcttctgttaagcctcctcaggccattgtttttgcccccacccgagagcttgctcatcagatcaccgaccatttgaatgccgtgtctcagttctgtcctatttctggaccgcgagtcatggctctgaccggtggactgtctatcatgaagcagcgacgtctcatgaaatggaaccctgccatcgttgtcgccaccccaggtcgattccacgagttcatcaccgataccgacggcatggttgatgtgtttaagcgaaccaagactgtggtaatggacgaagccgatcgaatgcttcaggatggacactatgaggatcttgacaaggccctggatctcattggacgaggaaaggtggccaaacgacagacatgtgtgttttcagccaccttccagaagtcgctcatgttcaagctggacaagaagcgaaagcaaagaacaggtctggccaccgatcaggaaaccatccgattcctcgtgtccaagatgaagttccgacagttccatcctacttttgtggacgccaaccctgccgaagttgtcgctcgacaggttctggagagtatcgtcgagtgtggcgccatggagaaggaccaatacctatactacttcctgctgacctaccccggcaaatccatcatttttgtcaactccatcgactctgtcaagcgtctcactcccatgttgcagaacctcgagctccccgctgtgcagctgcactccaacatgatccagaaggcccgtatgcggtccctagagcggttccgagacaacaagaacggtattctggttgcgactgatgtcgcagctcgaggtctggatatccccaatgtgcaccatgttgtgcattaccacctgcctcgaactgcagatgtctacgtgcatcgatctggacgtactgctcgagcgggaaacgagggtgtttctgtgctcctgtgttcgcccgacgaagcgtcgggacctctgcgaaagctgcgagctgccctgtcacgtgacaatgctcttgcgaagctgaaacctctgtccatgaactacgacgtgctggctcagatcaagccccgagtggagcttgccaaggagttggcggattcggttctggactccacacaggttggcaagcaggattcgtggctcaaggaggctgccgaggaccttggagtcgacttttccgactttgagaacgatacccacgatcacaagagccatgtgcgaaccaagctaggcaacaacagcaagaagggcatgaaggtgatgagcaaggaccagatggctcgtactcgaaaggagcttgagaagctacttagtaagcctctgggacgacattcgtccaaatacatcacttctactaacggaatcaacttggccaagatggttctggatggaaagtcgcatgacaagattatgggagtggctcctcagactgctggagagaccctgagaaagaagcgaaagaactagaaagcgaatagccgaagttcaatgcggaccaaaacatggaggagtttatagagcaatcataatggataagatgtactgttcaagttcaacagtagtataccgtacaggtgctggttgagttctacaaccactagttttgtgcgtaatcaagacaaatgatgggaacaactggttacctcaacaatacttttgcacctacatatctctaggaccgctcaattgttcaagactgtattgtattttcattagttacatccctttaacataagagaaggaaatgaacaattccttcagtaagagcgacgtacaggcgattaatagctataagtagcccacaaagcctctcattcagagtcatacattttccgttttattaaatcataattgcatcccatccatactttacaatcccagcggcagcgtgctctaggtaccggagacacactaacacactctcaatgacatttcttagtgctgcacactattcggttagaaccgtccccgacctctaggtccacctcgtcctctgggaccacctcggcctctaggtcctccacggcctctcataggtccgcctcgtcctcgagccgcacctggtccacctcttgccgcgccaggagcaccaggctcaacctttcttctcttggccttgggagtatcatcaatcaaaagagtatccaagggtagcgagtcggggagaatgaagaaccggattgtgttgcctcgaatgttgatgtagtcgagcgaggttgggggtcggttcttcatggtcatcttcacattcttgagtgtcgtgttcatattgttggacacagacatgactgttccgagaagaacggtacctgagttagtaatgacgtaggggaaagggggccgccatgtgcacattagagggagtgacagatgcagacacagatactgacagaagaccctgatagagccagagtagaccgagctctgtggaagtaggaacagctgtattcagcagacagcatattgatttaccagaccccagggtaaaacaggccgtgactgtgatgttccatggtcttgatcaaaggcggacaggcaagaagagcatgagaaatcagccagaatattgtaatagaggtagacggatcgtgtgaactgatgataccgcagcgaataacgtcatttcctcttaacgtcaatgcgtctgaccactgtctgttgatctcgcatattgcgaatcgcgtctgatggggtcaagcgtgtatacacgcgagaagacagcaatgcaagccgctataacaccatatacattatcagctgtcacagtatcacaccgaaaccattagccagactcccggtcctctcttgtctgtgtctcttctctcttacccagtctcccatcaaccttccgtgtaccatagtcagtgttcttatgaaccgccatgtcaccgtttgagtggaaaaagaatgtcacagcttgtaaagccgtttgtgcaatgtcagcccgcatcagtcaacattctcgcctgctccttcgcctccctcaactttagtcgacatgtacatgttgactcgttcatagtggatcagacttacaatagtaacaaacccatcatgatcgagccacgtgtctggatagctgtttgtgccacaatgtggttggttgttgggctctcctccgccatcaactcgagcttctcgctctttcgttctgttgttcgctcgtcagacgtgcttcgcactctgcactagtttccgcactcaccattcttcagctcaatctggaccgactccgaggtcagtttcatcaaaaatctgtgttagcaaagctcgcggggacgccagtgctcaatactcacctgaccaatttcattttgtgctgtggtgatcgagaagacgatttccagatatgatgcagtgtttttgccaaactcaatctgatgagtaagcaaggatggagaataatgcaagaatgggtgggagcagacaagttcaaatacccaagggatagactgagaacgacaacaatgctgaactcccgtcactgataataaccctccttgactcataacctgttcatgatcgcacacacttatcaggtgcatgtacaagcaccagtacacgcccagtacacgcccagtacacgcccagtacaaactccagtacaaactcgcatcagctcttttaagagactcgtgggtcgtagtcacgtgatctagtccagtggatttggcgtcgctctactccggtttatctgtttgatcacgtgagttttcgtggccacaagacagatatacccctccttgaattccctcgatttatttccatttatttccgaatacaaataaaaaataaattccaataaaaattccaatatttcctgtcccatatttacacacacccacgtgcccacaatcccaacaaaccctaacgaattagcacccgaacggagataagcggtttgccgtaattacgataggatggagcaagggggataatacgctacagtacatacagtacagtaatgaacttgtactgtatgtactccctgtcgactggggttagcaaatacgcctaatatccaatttagtggacagttggtcgtattacaggtacaatacggtatgtactggatacggtgaattcgacagggataaaacaccatatctccgaagatacaagttttgaaaacaagtggatacgatgatcacgttcaggagattgtctgctttcgaaagttatacttgttggtcgtatttcctcatcaatcggcgaaaattgtgcagctgttaaaccaagcatcttgtacatgcgatacgatacatacccccagcccccctctcaacgtttctgaaggctgtcatattgggagatggtcgtggaagtagtgcagcagtaaaatagagttagcaatacctcggcatatttggtctcttcaagaggtgccgagaggtcttcaatgaggatgaaaattacaccaatagactcctctttggctgagattcataatggtacaatttccatgattatagcccttatttagcgggaggtagggacatatcatttaccacttctgttttgttgaaactccaagtaactctaagtaatacctctgcaataggtgtcaaaacccctcaattcgatgttaccggggccaaaaagattcggaaaactcgtcatccataatttggagtctcaatcagccctttccagatcgagataccagcgaattctctctcttcagccgccaaactgcccacctcggtgaagcaacccaaacccggaggtaactctatttgttcccacacacacgacataccttgtcaccaccaaacctgcccacccgcaaaacactctcaaccatggtcaatctgtctctgcgtccccgtcctgccaaggccaagttcaagggtctgcccgccaacctcgaggtgtctcctgaggacacggtggcctctgtggtggcgaaattgagcgctgccaccaaactgtccaagtcccgaattcggctcactgtggccgatgaggagaatggaggcgctcccggagccaagaagaagcacattgtgctcaagcccgagcacgctgtcggcgattacctcttctccgactctcctgtggtgtttgtgaaggacttgggcccccagatcccctggagaaccgtcttcattctcgagtacctgggacctcttctggcccaccccatcatcttctttggccagaagttcttttaccgacagagctttgagtacacgtttgctcagaagctggtcttcactctatgcatgctgcatttcctcaagcgagagattgagaccatctacatccacaagttctcctccgccaccatgcctctgttcaacctctttaagaactccggctactactggttcattgccggtttcaaccttgcctttttcgtttatgcccccgcctccttttcttctccccaggctcctctgtggaagcgtttcctcttttccactggcttctttgagcgaacccctctgttcctcaacctcatggccgccctgtggctctggggagagacctccaacttctggacccacttcaacttggcttctctgagaaacgatggctccaaggaccacaagatcccctttggctacggcttcaaccttgtttcctgccccaactacttctttgaggttgtcagctggatcgcaattgccctcatgtgtggcaactggtccgcttatgtctttactgccattggcttcggtcagatgtacgtctgggccgtccagaagcaccgacgatacaagcgggagtttggagaccggtaccctcgaaacagaaaggtcatggttcctttcttgctttagatgcaacgagcttgcgaattgtatctacatccggtggttatttcaaccaagtgttttggcctacatcacaatacgattaaatcgtgtttgattgtacgtcaacacgataaagaaagaaagacactccagagtcggagtatataggtaatatctatgagtaaagtacaagagcactacagtaagtacgctgtactgtgtgtactgtggtgcagcgtgttgaatctatgggggacttgggatactgtaaaaagtgagttttgacaaatatcacttgccagtatcttgaacagcttcaacaatagtatcatcaccttgacagtcaaggagactgtgcaagaccgcatactgctgtttccacacgcttgtgtactcggcctggagctggttcagggcaacattgttctcgggaacatccaagacaaacgagcggagggtatccaggttactttcaaaatcctgtcgcatgatatccatgtaacgaagtagatcttccgtgtgatcttgcgacgcagaggcgtattcgagaaggtctctgtatttaaccgtggggaacttgtggcggaggtacggagttgactttgtgaccttcaatttgtatgttgtcattgctggtggggtagagggccattgggggttaagcgtgtcttatatgtcttttgtctcttacattggctatgttgtgatacgtgggctacttgtactgctaccgtagggcaattcaataattcttctctgccaaccccgactctcatttacgacacgcgcggtcaatcattcagacccagcttatcaatcttggccttggaaacatccaacatgaactccaccacctcttgcttgggcattccatacaagggctcagcaacatgctctaactcgttccactggtctctcgcaaaagcagcaaaatattcccgcatctgctcgttctgtgcttcaaacgcgttcctccacccagtcagacactttgtcatgtccaactcctcggtcttgatcctgaacactgcaagatgtcgcagttcggggatatcatagacgtcagccaggaccagcaacccggtagcttgttcaaactccgcctcgaacggctccccgtagaaatacgacaccatgacctccacccacgcatgtggatatgggatttcaagccgtttctcgcgcgaatcgatcatgttagcgtcgatcattgcagcaaaaaagggtagagaggccttgaacacgacagagtggatggggatggttccttctttggtgacgagcgtgaagtcaaagtccccgtttaaccgcactttggataagcccacaagtctctgagagtagtggagagtcattacttcacagagaagcttttcaccaatgctgcttatcaaatggctcgacgcatctccattgatgatgaaaatcaaaccattagacatcttcatcaggaaagtgtttgaagcggttttgactaccagcttcatttgaagggctctccaagggacagtactcatactagttccggtgcctgctcccgaaaattgttggagggtgaaggagccatgtctgctgatagttttctcagagttgtcgtacacggaaaagatgacggtttctccctcggagcataggtaagctgttttatgcaggtcaattgcatacctcgccttgtggttcttttccaggctctctagcttgatttgaacctggtccatgttattgtcggtcattgagctgaagatgggatgacatgtacatacggtacaacaggaaccaagtttggtgcggttcatcttctcagtttatctacgaaaaaatgttagcaagtgcaagtacgtactgtacttttatccggcatgcccaaggcagatcggaaagtcgagcgggacttgctacgagtacagtaatgtacactgtacattcaagtaggcatttcctacgatatccttctaatcaaagataagtaacaacagtcaatgatgcttattcttacttcatatgactagtcttggaagtctttccaagtcttacaatccctcttatttatcatattctccatgatcgagagaattataaatgtgataaccctgactaacatgagtgttatgcctcaagataacagcgcaaataaacagtctctggtgtatcccatcgactatttcgctcaccgatcttcatctgtttatcaagggtctagacatgtattaagagaattgctgaccgtttatttcagaagttacataaagatttgtcttcttagatcgctccttagttcttcaacacaatctccgaactcctgattacctgaaccgatctgcgtgcatttggggtaactacggtactggaaggtatcatcagggtcagactgggtcatcttccaggtttggtgaggtgggtgaactacacacttgtatcagcagggacatggtgttttaactggacgttcgaaacactcaattgaaccaccgttcaagacccaagtgtgtcaaacgcaccgtcaaacgtaccgtgaacagattggtgcctcttgcgtcgttcttccgtcgtcaattggcaaaacaccctccccacttcccacttggccctttgtctcctcacttcggccaatttgctttgttggtatcgatcccgtactggtctggatgcggactccgattcttctttggtatctctctgtactggacggaattgttcttgatggaaggatgttcgccctcacacggatatttctgtgaaaaagcgcgggagctgaatgttgacatggtcatgtatccaggtcgatggtgatggtgttttactgcaatatgcgcgagctgcataaataaaacggtgcggctcggaattgatctcaactaatccccggcatcgaaccatcacaacaatggagagagccaggagagaccactgcagaccactgcagaccactggagaccactggagagacagggctattgttttgttaggctttataaccctgcacgatatcatcttccttgtttcaccataacgtctgtaggatatgtttctttgttgaagaattcaggctgtattagtctaaataatatatagcgtaataatattatatgttattatagagtatggtactgtacgctattgaattgttagaactattggtttcggattatctaccgcaacccttttgtcagttgattaaaatacacatgcgaatttttacccaaaatttacaagtactggtaccagaattcacccaatttgttctgatttgtgtccctttgtcaacacgtgtttcagtttcgacattttacaccacggacttgcttttagttggtgtctcagattgagtgacataaagaaaatcggctagacgggagaaactggccatcgacagcaggataaatgaaggaacaaacgtgtatgtacgcctcgagcgtgtatgagaggatgtacctttgatttgtcgtacgattgttattttttcttgaattttatccaatttaaccagaattctcgcataattctagaattttctagaatattaaaagaaaatcaataccactactcgtatttttttttatctacatgaaccgatattgataaacccatcctgtattactaatagctataaattatctttacccagaggcagaggaaggcactctgactgtctgtctctcttgcatctaccctgtgaaagccttcttgatcgatctgaacggtctcagcagtcgaggcaccttgtggctctgaatcacgtcagccgaggtcgacatggagtcctcccgtcttggctgcggtggcagtgtatcgttatagacggcgttgtagggcatttggaacgtcttcttctgggtctgggacggaggggccataccggccttggacaggagccgttgtcggtttttcatgaccgattcgcccacatcgggatctgcactggcctggttccaaactcggttggagttgatggtggcactttcgtccagcttgtcccacacgtagtcgtgctcggtcttgttgccatataagggtctcgatcccgtcgtgaggatggactgctgagaggtgtgtgaagagacggacatggcggccgaattatctgagcggatttgagagaacacctgcggcgacttggttcttgttcttgttcttgttgtcgttgttgtagttgttgttattacagagctgtttgcgataatacccaagagcgaagagtcggatcctggttcgtttgtgtagctattggttattgtggagcgatctgtgagcgactgtcttgtgtgtcttttgttggtgtggccagattgagtgtttgtctaatgtcgttagtgactgtccgtgacctggtgcggcaatgttttgcgagtcggaatttggattgttggtttttttttgagtgtccgatttttaggcgggccatctcagatatatgagcaagctttagccgttgggtgcacatggcttagcccactcatgacctaaccaaccttgaacagaaaacacggcgacttttcgttgctggctggataatgagaaatgggtggaatcaaatcgagtcccacgagagagtcccacggggccgcgacgccggtggtcacgtggccacccccctacgtttggcgagtcgcgatggggtgttttgcaacattgctacctgcacttgttatggatggttactgtttcacctttcagtaagctgacgttccaaaataagcgcaagtccgacagcccagccttttagtgggttttacacagtaattaagttgtcggctttagtatgggttggtggtataaaataaaaaataaaaataaaaaataaaaaataaatattccagagtccgtcagaaaagtccaaagacgtcagaaatgccaaccgtagacacaacaaaggatccgccccgctctaccccacacgtccgtccgactcggccccctgaccacacgacagcgtccacactgtctcactttcacattctccacttactggatagatgcaggtacaaactatcgaccgtgaatgtgacgacttcacgagacgtaaagggcccaagtagtggcttaataagcaccgaggacgttgcagactgtaccaggctcgttcaacccacaatttttgcctctaactacaagtttcaaacctcggaaatgcacctaccccactccttccggcacatccatcgacgctccattccaggggctttcggtagtgtcaaattgaaataatatcgcccctagactcgaaccaagttccaaacccgccagaaccatgctgcaaccacgcttcggtgccggaaacaaaacctacacgcccctcattaacatttgaaacactccttcgaacgggaaagatcgggttgaaagtgacagcttgttggggatggtatgttggagacatcatgatcgggggaatagctttgtagacccgacgtgtgtgtacactgtatgagtacatgctatacttctgctcgtacttttagaggtacagtatgtactggtaggatcattcaaactgcctactagtacattctctcatgttcaagtcccgataacggaatggcgacaaaaacgttgcattagtgaactgagtgatacccaagtcatatcaatcgtaacaaaaagctcgataagacctctgtcgcctttgtctgtagcactgtcgccttgtaaaaagtcttccattacatcctaaatgattcgaatacttacccactcgtctattacaagatacaactcagtgatgatcttatatactgtcaaaactgctgcagaatgagcgaaaagccaccctacaattacctatccggacactaataactattcagccgtgcccaaagacatccaatgaaactacataagaataatcgacaattagagtgcccagatgagttgccattgtcatttgaagtggttaaaattcatgtataggcgactcattccttaatcaaaccaccccatatgcccgctgctcatttcttactcttttttcggtgtttttagtcttttttttattctaatgattcggttagtcagctttatccacattttgtatgtcaaaatccataaaatgtaacaattcgcctggctagctcaatcggtagagcgtgagactcttatccaaaggtcatctcaaggctgtgggttcaagccccacgtcgggctttcttttttcgcacatctgacgttcggtattctcctttttcctctatgctccaatatccggttattcatcttctcggaactttattccaaaaaatattaacgtttaaaccttaatatggagaaactttttgttttccttttctttgtgtgaccgaaaaacccataaagaatggggaaatggggaaatggggaaaattgaaaaaaagaattgccttcgaccagatttgaactgatgatctcagcattactagtgctgcgccttaccacttggccacgaaggctggttatacgaatttttaaaaacattttcattgttatcggaagactgattagtcattaacccgtcattaggataaaaaaaaaaaaaacccggtttactaggtatatagctgtaatgaatcattagaataaaaaaaaaggtagaaaatgcgaaaaaatacgaaaaatacgaaaaaatacgaaaaaactaggaaacttgttgtagaaggtgattttctgacagggtgaaatggaatgagtttcagttggaacttcattatcccatttctaaggcgataatctctattcagatatttactcctccggtggaagcaataccgaagctatggaagagtcgtgtgatctcttcaaaggtgaatatataggatggaggagaacttgaacattgggtgtttttgattgtgatttcaaactgaagtacgcagttcttggtatggtagccgataatctacgtgcctgatagaggaattgtagtgtgccccagctgccctgttgaccaagcagctttttatgacattgtggtttacattctagtagtagtagttacgagagctaggccctacgtgtgtgctatcaagtcggaacacattgtgcaggtttggtattatatgactgttgatgttggatacagacgcttggagcattgtatggtacgtatcctggtgagcgcaagcgttcgagagtcgcgtttatatatatttaaatcgaatcagattaaccagagggttccataaaactcattcggtagtcttgcttcccattttattcaattatctcattcaaagtggttgtccttcaagatacagtatgtacacagtacacagtacatacaatattgtatttgaggataacagcttctaagcttgtgattttggtgcttttagagactaatgggtccacaagaagaagcacgtcaaccggctcatgttggagatgttctacttgcatgtgtttgtgagttgacactgctggcgactccaacttcaagtgtatggggaaggaagtaactaatgtaaagatagtatactcattacacattaacactagggtataaacagtatgctggacttcttggtactatacagcaccgtcgggtcactatcaaccctcctctgggttcctccaacaatcaatcaaatctatatgcaatgtctatgtatgtactaggccattaaaccactatctctggttacaggcgagcaacagctgcttcatttccggagcagtgtgtgcgtaagggtgctggcgtctccaggggtttctctcaatctttttcttcaggagaacctgctccacacatccatgagggtctcgttggaacggcagaaaagcgtgttccagttcaccggcatcaggaagctcgtcctcgccccaaacaggatcaatgccgacgtactcaaacttgtcagaatcatatcctacggctggtcggtgcagttgttcaaaccgggctcttttgaactcgtagccgaccacggtgattctgactgggtaccggcccgtcagctccctgaacctcgcaatcgaaaacgccaggttctcgtacgagtcacgtgcgtactcctccactgctgtctgagacatgtctaatcccagagcctccgccagctggtagtaggaggttccctcggaaatggggcctgcagcctttttggtctgacctccagagaagagtaagagcgccgaggggtcttctgacgctcgtcgcactccctcggtgatgtgtttgagcagaatgtcggttttgccctccagaaacgggcctgcaacccagtccgaaaacgccagtcccggcagcttggtgctgctctttcggggctgtttccacacaccatggcacggcaccatgaccaggtgatctgtgtcactctccacgcccggaaagtccaaagtgcggtcgaagaacgcgctgggtctggatcgggtgctctcggtggctgctgctccgagtttcatggccaaatcgggcttggaaatgataaacgccatgatcagaagagacacaaccgccagggccagaataataacgcgtcgagagcgtcttatccgactagccagtgtcattatgagagtggtgatcgtgttctatgcatgaactttcactgacattactggtatgatactagtgtgaggctaatggacactaaattaaagacacttatttagtgcgaataatttggatttaatcgatacaatcggggaaacaacggaaatcaattctagtcacatgattatagctcacaaaataatttttcaaaagatttgtggtccaaaaactgccacaaatgacgctcccaatcacctcgcccttttgctctcatgtaagggtccagcttgcttttcaaagtctatttttggtttagcacgaagcagtcatccaaaactaagtttggattttagttgactttatggaatttttagttgacctgatacttgaatatttgtttggacgaccgcccaagataaaaccattcacatgaaatagaggtgataggatagtacacattttgtggttaattccacttgttcgttcaatataactctcatcgactacaattggccacgttagtgggtccagttcctactctagcgaacactacatgcctacatgctctacagtatgcaccatatcttcaggcagctacaagtagtagaactgatggacatggtatctggtcgcagttgtgccggtacgagtagagttcttatattgtcgtctactcgtacctacaatcacaatgagacagctcattgggtgcacttctgacctgattacggtcagtcagtcccgcagtgctcagtcagaataatttactatttacatatatacaaaagacctaggccttggagtcgtcgctgtacttgctctggagcttcttgatctcttcgggatcaagaggaggaataggcacatcgccaaagtcgtcggtacgcagagagtacatggtgtatccgtagataccggcgacaaaaccggtgaggccggccagagcgagcatgtttcgcacaaagaagggtcgtcgggcccgaatcagagcgggggacatctggaaggtcttggggtcaatgtacttgccctttcggaaactgtgttagaatggaacggtcgagcatggtcgaaggtcaggggtcagaggtcagaggtcagaggtcagaggtcagaggtcaggagtaggtccttcaagataccatcgaaagtttagagggtgtagttgtgataaaaccgacgtgctgcttgctgtagcaattgattggctggttgcggcatgtggctagccacagcaatgcagagttcaaacgggtctgtcacaagcaagacaacgtgtagattttctggagaagagaaggatgaaggagacacatttctcattcacggtgttgtcctggtcacaaaatgtccgtgtagatactgaacccagagttgcattgagagatcagtggctctgatcgtcgcacgcagctgtagtgtcttgaagagagtgagattggtagtttgattgcaagtcgctttggggaataccaaccaaacacgtctcttcaaatagcccatttcaaccacaacttctcttcacactcccgtccaccattagccacccgaatccaacctccaccgccaacactgcctgagtgtcgcagccacctcctgtctctgattacgacacatatcatggcgtgtcaatctctcgattgtcgtgatactcacactttgagaccgggctggggttgcttgtgcacctcaaaggtgccctttccgttatggggatcctgagacatgtttctgtgatgtgtgggtgtgtgtgatatgagcccttgggtggtgagattttgacctcatgagattttgagtttggagacaaggcgaacaggtagggtaacttcattgcatacaggatgcgctctcctggatatgtggtgatgggccaaaagattttgaaaagattcctgaatcagtgcgacaatggcaaaaattcaactgcgacacaagaaacggttcagcgcgttgggaaacaagcccgttaagaaagcggcgtctccagacagagcgggctccgccacggacaccccgactgctgttcctgaaaagctgactgagaaagaggaagagctcaagactagcacagaggaaactgcggtggaaaagactccggctcagacagagtcccccgtgaataccgctgcatcttacaagcagacaatggtgcccaactcggtccgaaaacggctgagagccgaaaagcgagctgccaagggccagtcggttggggcggatggaaagactgtggttgtagagactgcggttgtagatactattgctggtgatgcggctgcggactcaacgacaactgagactcaaactgctccgaaacgcctcggaaacctgtttaatttgcgagcccagcaggagaaggaagtaagggaagacaccaaggtcgagatcatcaagccacaggctattggggacaatgttacacaagtggctgagccaccgattattgtagtttctgaaaaaacacatgcccaaacgctggatgcagcgcctcggcccaagaatcgaagcaaagatcgagaatttgagaatctggcgaatgacaacatccacgagttctcagtggacgctttcacggaggaatcggaaagactcaaggccgaaggaaagcttgacgagtacaagcgacctcttacggccattggaggaggcaagcaccagatcaccagtctgttgcgacaagcccaggacaacaaggagcagctggaggcgtcatactctcagaatcgccttacccaaaaggagagtggagcaaagtatggattttagagcgaaaaatcgtgactgcacgactatgtttactgtattatatatttattgcatttatttaaaatcagatttataagtgtagaagatctcttccgtcctaattgtagattgtctgctctacagtaactcgttcgctccgcataaatgattagacccattaccactgtacctgtacatacagtagtcgtatcgcaataccaatatctcaccttgacatcctgtataatccaaaatatattacttttcactaattccatcccatctgcatctatttgaagtccttgaaagaccacttctcggtcaccttcttcttgtatcggggcttgaggttgtgtcgctttcgagcctcgatctttcctcgctgctgcagcgatcggaaccggtctcgcatcaacgatccctcgggcttgagtcgtcgaagagagtctgtgagctcgcctgagagcttgacatcgagagtgggctccagaatttcgtatttgccgtaccgacgggttcgcaccttctcggcagcctcgcctcctgcaatgagatccttgagatcctgcttctcctgctcggacttctcggaccgcttggcgagctgttgcatcttctcatgaatcttcttcatctccatcttcatttgttttcgaattcgttccttttccttgtgttctcgcatctgtcgtcgcttagccatgctctttcgcttctccttggcaggcgcgttgatagacagaccgacgctaccgccctcgagttcctcatcagaggcctcctcctcttcctcctcggacgagtaatccatctgcttgtcctcgtggtcctccatggtgtccatgagatgctggacacgggcttggtcggcctccagctgcagtcgttcctcctccaatgcctcttccttggccagctcctccttgagaagagcctgccaggcctccagagagggattgtaagatcgaccctcgtggggaacctcaatagccttgtcagtggctccaaagacaagaggcttgtggtccagagtggaaggtcgcacagtgcttcgggttcgagaagtggcctctctgtgatcaccgttagcaaaagtagcccgcatgatgttctcaggcttagcagacttgggcatgtatgcaacccgagatccagcattcttgaccttggtcatactctgagggaaaccctggaactcggatcggggcttgaccaccttggatgcagtaatggtcttcttcttgggaaccacaggagcgggggcctcgtcccatgcgtcgtaaacaggagtctccaggacagagtcggcttgcagagcagcctcggtcatcttgttgtccacatctcgtcgtccagccttcttcaacagcatatccagctgctccttgctcatcttcttctccttcttggtctttttgccaatcacgccggggacagcagatcgccgggcaagaatctcgtccgacttgagacgcttctccttctttttgctatggtaagtctcgacatcgccagacgttccagctgtgtccacagtgaagagagcatcaccagcctgctccaggttcttggagccaaactgccgctcgttttctcgagcgctgtctagaccggcgttcagatcctccagatcaatgttctttctccacgccttctttccttttctgctcgtttgtttgctcatgttgtcgtgtgcttaggaaaactgccctttggaattttcttccataatgcatcaacctgcacattttttagagttagtcttcctgttgggttagggctgagtagtattgaaaccttaaatccgaaataagagacacagaccacaaactcacctcttttgtgtatactgtactagttaatctcggaatcttggtattcaacttcttcttcttctccttctttttcttttcgacttttcggtttcccgtcattgaaaaccgccgcctactaacgccactaacaaagcataccctcattgagatacatcgctactgatacccccgtttgataccgacttctccccgtgacacccctggtgtgatatcctggtgtgatatccgctctgagacctatctgtgacactgtctcatctgtcaaagcagtaataccagcgacttccgtgtcttgctcgatacgcacccgtctcaccgacggaccgataccatggccaccaccgtccttgctgacctggcagtcttgttacacaaaatctcgcatgaagtggacacggcagaaatcaacggcaagctcaaagatgtctactccatcctcgaaccgaccattgcggagttcaaacgactcggcgccaaggccagactgcacgatgtccccgacgcactctggaagtctctgacccaaaccatcaccacaatcatgactctgtgtgagcagcgtggtttggagaaagagcgacagatgtgggcttcaaaatgggccacgttcaagcagtcctaccaaaagggcaaggccgccttagccgaggagcgcaggcggtgcgacaatctcaagtccgaagtcgatgctcttcgtgaccagctcaaagatctgcaaaccgcgggttcgaatatgtctgagagtcgcaaattggcagacgaagaacatctcgcaagacacatgcagcatctcagcgacgccaacaacgacaagatcaaagcgatcgcggagattgagaagctcaaggccagcgagcagattgcagagctcaagttcaacatggtctcaaaagaacgtgacgaagcgctcaatcatgttgcaaagctacagtcgcaactggtatccaaggatgaggagctgacagaagtcctgggccgtgtcaagtccgacgccacccagactcagatggctttgtctgacgccgaagctcagctggcccaaatggataaggagatacagaccatgcgatcccaattgaccagtaaggaaaatgaggttcatgacctgcaggcccgactggaccatacactggagcagaacacatccattgccaaggagctggaggataccaaagataaggcgatacaactacaggccagcttggaggacttttcctcccgtgagtctcagttccaacagttccgcaggagtccccacgacctcaatatggctcctcttggccatatacagcaactgcatcccaacatgcactcgccctctactggaacccctccttctctgcttcattcaattcaacacactccaccttcgcatgcattccctatgcaacacacgccacctccgcatttgcaagctaaccatcattaccaatcaacaccacctcgtcatggctcataccaccagtcgtcgcctcttcacagtgcataccacgggacgccgcctcttcacagctcctactaccagtcgccgtctccgaaccacgtctacaatcaagctttctcgccatgtgttggccagggatctccttacggcggtcaaacatcagctcatggatacccaaataagggtccccctcgaccccgaacgaatggaagggacggaacgtcgagaccacagactgctcacagtattgccaaccaacagcaccaggagcccctcgagggctactttactgatcaacctagtccgtttgtggaccagccgtctcagaagcataaccgcccggtatcgaaaggggtccgatggcctgataatctcccagacacgcctttgatgacgatgaaccgcggtgataaatgcgagaacaaaaggccgagcacaagccactcagacagcgccggtatcgtcgaagccacccctgtcaagaccaagtcgagtccttccaaggagaatgttagccctgccaagcctggcacgagtccctccaaggcctctcccacaaagtacggtactctgaagaggaaacttagggggattcgtaggcctccctacgggtacatgacaggaacatccggtggaaccgtgacagcggaggctgcgctccgtctcgaccatcccattgtttcgtgggaaggtccctactttcattcccgctcccgctttggcccagtcccagcgtttttggatgagcggctggagacgatgaagcaagatctcagtccttctctcgtcgccctgatgtggagcaaaagttgtcgacgagccttgcgtcgcaggcctgaagggccgggtggagtaaatatcgaatcgcttaagcctttgcaatttgaaaagaccaagatgaaactggcagatgggctcggagaccgcatgtgtctgggttccttaacttggccagtgcagattcatgtcaattagatgagcaagttgctagttaaaagatatgtgggtgtatgtatgccgttgctgtacatactagtacagcatgttatataacgatatgtgattactgttcttcatctcatctccactcaggtcagaggtcgtcaactgtaattacagtgctgtatctaaagtaaccaaaagctccccatattctttattctcttttggagacttctagaggaagcccccggcaatggagattcggttctccttggttccgtagacggagagctccttggtaagagaccggtgtagcagaacacaccaatcgcaactgttctgttcgttctcgagaaagaatacgttggtccggcagacgagcaactgagcgcgcgtgtcagaagggctcagtatatcctgggcgatttggagctgatgtttcacagagaggacgacgacgactacaacaagggctgtgagatcttgtttgccaatctgcggacggaactgcgcaagtcaagccccttttgtattttggacccaccaaaatagggcgtttggtacgagacgcattggcgggagtacaactccgtgatcgaggctgtgcccgccattaaattgataggcaggctgatatcactgggtgaaacgagtgttcgaagctcaaggtggaggctttacaaattttacaagagcgaatcaatacactggttggtaaggcttttcagaaagaagagtctgtgaaatgattggtcaaggcgacaacttttctcagagtacttggaccagacgaatagtcgccctggctaacctgatttacactcatttagacctgaaaacttgcgtttagctcagagagatcaattctttttggtacacgtttttccagcaggcagggggtgttctagaggacaagatcagacggtggtcttcatgaatgcaacctggcggcaagctagccacttggagggactgagctttggtcttcgtgaagcgtctttcaagtagaaagtgggaaactacagacttgaacaggttgaagtaaggagaagaaacgagttgaaggtcgagaagcagactgcaaggctcttagatgaccgaccaactttgatggattcaatgctcgaaaggaagacataatggactacaagaagaaacgtgaactactggtccttgatgaagaggagttccatcttgacttgaaaacacttcgcactaaaagaattgtccgtgagtcccacgtccagattgtttcttctcagtctacagtacaatgtaattgcaaacacacactcggtatatatcataataatcaataaattaacgtcattcattcctcctctactcctctcccataggagtcaactgctccagatgatcattcttgactcgggctaaccaggggtcgttggacagctcgatggcgctctctcgcttgttggggtctctatccagacactttagcaggaacgcctgaccctcgggggacaactgctcagcactaggcagttggggcatgtgtccagaggcaatatggaacatgatggcgtactcattgtccaggttggaccatggtcgtctgccagtagccatttccaaaaccacacaacccagagaccagatatcaattgccccttgtcgaccagggttagaacctgtaattacctcaggagacatgtacatgggtgtacctgtcagtgagtttatcttggaacgggttccagtctgggcagcccgggttcggccatttcgggcaatcaccttggctgcaccgaagtcaacaaacttgatgagaccattgtggtccagaagaatgttctcgggcttgagatctcgatgtacgataccagcatgatgcaggtaagccagaccctgaagcatctggaaagtgtagacctgaataacctgctcgtcttcgattcgaccgtgcgacagcagatcggcaatggacccaccctggcaaatctccataaacagatagaccctgtctcgatggacctccacgccaaagtactgcacaatattgggatggtgaagcatctccaacactgtcatttcatccttgatggccttgacgatagttcggattgactgagcgtcctgcagacgaatctccttgacagccatcatctcaccattatccaaattgagagcagagtaaacgtctccaaaggttccagaaccaatgaaccgacccagctgccatcgcatggtgacgttggagaaggctgacgccagcgacatgaggaactggtcatcggcagacccgtcgtccaaaactcgacccacgtaatggtgctcgaactcgaggtcgtttcgctttcgctccagatcctccagcttcttgacagcgtcgtttcggaacgcctccatcagctcggtgtcatccttaaacgacatatgcgagatcttcttgcgacgggcagaggtgacctcgaccttttgctgggccttggccttggaccgagcgcccataatgtcgaaatgcgaaatcaagagagacatgcatccggcaaccttgactcgcagccgcaagaacgcctcctcgttgacggcgagaatgttaacgccagatgtcataacagacgcaaactcaagagccgtcaccgtgtaacggaaagtacggtactccgtagaagtacagtcgtcaaccacgaaggagacccactcgatacaaagattgatgagcttcatggtcacgtagcctctcttgggtccctccagtgaccgcagacctcgctggccaaactcacgtgcgaaaacgaacatgttctgcactgtgtcctggcatcccagacccttgagagtgtgtctgatggtggccacgttgtcaatgaccgacatggagagccggaagaagagtttccgaagacgtccgaactcatgatcgacacgcaactggttggatttcgcttcaaccacggtgttgagaaattctcgctcacatacctcggcaaactgtgtcttggcaagctgcagcatgtgtgtacctccctcggacacgattcgcattcgacccatcttgatttccaggtcaaaagatggcatgtcaatgttgagaatctctccttcccagataaagggctcttccgaacatagaatcagcacatgtgcgatgtgatcgtactccacactgtcctcctcaggtcgccggtaacgagagtatccacgaatgatctccttgagcttgtgtggccgctctcgaagagaaggatccgcaaacacgtagataccgtctcgctcaagcactccagtgtagacaagaaagtagttggctcgacgaactgagttaacaatggcacccaaccgagagggctggattgcgtactcggaagcattctcgtaagaggaacacatggaggtgtagaaccgaataagattccgctcaaacgatcgaatctgctcggcggtttcggagtagaaagcggcaatctcgttagcttgatcagaggcaggacccttgagtgaatcctgccagtaatctaacagcttagtcatcaacttcgacgttaggtaggaaaactgctcggcaacaaggtaatcgccgccggaaatccactcgccaatcttcgacaagaacttgtactggaactcgagctgctcaccctccttgaatgttcggaacacagcgttggacgactcgagaaacttccgagacagcagatcaaagtagaaagagacacagtcgatcagagtctcgtcaaaggcatcaccgatggtgtccttgagcggccaagggccatcctgggtgggagacacaaaaaacatgtatctctctttggccttgagagacagctcaatgtatcctctaatgtcgaccatagtctggtcgatcatcatcatagtagggttggcgagctttctggcgtagttgagccgggttcgcatcacctccatgatcaaaagtgaagggaaacgtgccaatgatccaatgtggtcgtaaagcacaggcagcccaagcgtctgaaaggtgtcgtggtactccagagctgaggttcgagctcgatccacaagctgcgaaagaggtcccagcactcggttttcgaaaatgttcttgagatcctgtcccttgagcagccgctcaatgaacggcgacttgtcggccatcatatcgttgccctcggccggtcgtgtcagatcaatgtcctcgtttccaatccactgctggagaagtctaatctccgtaccaatgttccaggtcagagaagaccatgtcagcagagctgtgagacgttcctggaactcctggctgccgtaaaaaggcttgtccgtctcaatgagcgagtacgagcgccacagttgctcgaaattgtccaaacgattcagcaggtcctccacctggtcagacgccgatcgtcctcccgcctcatctgcaggcttagctctgaaattgaccacctccagaagaattccgtccttagtatttcgcgagtactcaatgatcctccgctgctcgtccatagaccggccacagacctttgctctgactcccatccacaactcttcagccacgagcttcttgtccatttccggtggtgctcgcagacgctgtttctcatttttgaccacctctcccgtgagcacagacgtcagcatgctctgccactgaagccgttctctgatggactctgatttttcagcgtcatcagcattgtacttggcctccagaaacgggtagctaatagctccagagtcgtcgaaaaatgtgcccactcctccgagtcccacaaagtcgccctcaaactcactcagagactcctcgtccgaagatctatccagatcggatgcaggaatacctttcgtgtagtagtcgtctgcaaggttgtttcgcattttctgcaggtatgcgcgctcctgggcgtagtactgtgcgttggacgacggcttggagcccgacacagaagggacagctccctggctggtcttgcgagtgcctcgctggttgttttgagacggatgtcgcgcaggagcataggtgttggagggttgtcgtgaggggctcttgggtcgtacggtgtttgaattgtttgtcgcaggcactgtctgtggggtcacggggtgcaccgaggcattgtcgttgggtgaagctggcgtggagagtgttctgacgctgagattgtgattggagtcaaagtacccgcctggggaagagcttcctggatgtgggctgtatgcggaattgcacaacagcggcgacgtggttcctcccctcgtcacggttgctgcagagggcgcgtcgagagacccagaccgtttacgtcctgccgcggtggctccagccaaagcagctccaatggcccgagctccgttcgtttcggggattgcaagcgtcggcgcagaaacatttggcattgacatgatcttgtcggctccgggagtcttgggcagcactgacagtggagatgtcacgataggtgtcgtcgatgttgctccgacaaggcctccctgggggagagctggcgagtggatgggggtgtgtagtggtgatcttcgcgcccccgaagacacgcttgtcttctccgggtggtctgacattgatttggtccgaacaggcttgtttttgccgtcgtccatgtcgaaaaatgtgtgatgttgttggtggattttacgtccagatatcgctgctgcagcaattaggttgtgtcgacagttttaagttccagaagcgaggctgagagaatgagcgatggcggtggtgtgcaagcacggggaggagggagcggcttggggggcgaacagagaagcgaagtggatgactgtgggataagtagttgattaaatacgcccgtaacaagagatgggctgttttgagagttgcttagtcagctcaggtggctgggggggcaagttgggtgttggttgttgatggactacagtacagtatgtagttatgtatgtacatacttgtaggggaaaaaaattaaaataaaaaaatggacaagtactgtaggatcaaagtgctgttgatcaagttgttactcgcgctggtagagtgtggagttggttttatatcgtctgtttcatctgtttcgttcccgtacgcctggttgaatgaggggtttcactgactgaggttgtggtaagtaattcgtcaaccgcgtgtattgagttacttggcgttagttgggatgtgagaggagaggaggtattcccgaaccgtgaataaaatggcgcgcagcgttaggtcctgtgtcgtgctgtgtggtaaatgcgcgcctcctcgtcttcctggttcgccctggttggatcggactgagatgtagaacatttggaccaccagttgcttcttactggagaagtacagtataaccctgtttgcttggattcgataattaaaataaaaaattcaaagaaaagaaaaaaaaatctcttcacacagatgtttagttaatcgaatgtattaagaaagaaaaaatataaaaatatataaaaatatataaaaaaatcagtcgaatggtgcaaatacaggcaattgctgttctcgcaaattcttcaagaactctcatggttttgctgaacaatatctacaatattaccaaacccaacactgttgaaggtaatacccggtggggtaatacctggctaattcctcacataatgatgagatgtcaccacatagtaatgagaggaatcagctgggtcgtagacgagatgtccatcctgtagatagttttatccactgatctagaatctcttttctggtgaatgagcaagcacacacccttctggtgtgtgctactatcggaacgccgtgtccctagaagtgggttgtaagttgttaattaactatatcacatcaataatacttatgatcttcaataaacacccccgattggcccacggatctctctgcaggcagcccaagacaatgtttttcttcaattgacgaggccagggaaatgacgagacctaagtagccccgaatatcggtaaatagggaagtattctctaggtccacgcaattgtctcgacaataacggcatttattccaatgtcctctaacttagagaagggtgaggtgaaggagatcatagagcacggctagatgatgtgttctagagccgaagacatgaatcgtattgtatgagtcagtggatgtctgtggttaatttttttggcccgttccagtcatttctccaagtttcatttgaggactgctggtcattattctataatgatgcgattttccagctgcaatacatttacgcctgttcagatgtcaagtcccaccagtgtttacggcataactcgcgaaccctttgacaatgtacaagtacaacaagtatttgtagttgcttgtagtatgttacaaatactcaccgcttttcgtgtccatattcgacgttacaagtacaagtactgtacttgtataagggttgagatgtctggcggttttcctaaattcaatttagagatattcaacagataatcaccaataaatggaacttgactaattataaaagcgtcgataccaaaacgaccatacagcgcgacaggggagccgccactacacacgccaagggcagatagtcaagatggatgcgagaacggatatgggctcggatcaagggccagatcactcccctggcctttcgaatggcgaagatgccgacgaacaactcgaattcgtactggagaagatggagattaggacgaaattcagcacaggtgtgaaggaattcgacgaaggaaagaaggagttgtatttcaaggtgcctccaaggacaattattggcaacatccactcgaaactcatccacctggtgattgagaacccaatgcatcacaacagatacgcgaagccgttgggcaaagctcctctcaagggagacgacaataagaagcaagggagatggagtgctcacttccgaaatttatgggttgatgcccaagcaacgagtgccgaagatcctgtgattccatgtgctccacaacgttgccaggaaccacccactcttccaactagcccctcccctcctcaaccagagcctgcttcaatcccggaggacgattggagttgtcttgctgacgcagtccaacaagacatctatgaccaagaagaagacaacgaagcccaactccaagggttcgatgacgattcaggaagaccccacgaaggatgcgaacccgaagatcttggagagaccatggacgagacgtcagatcagaattcgaataggattccagataccgattcggaggaggatcagggctcggggattcaaagtgaaagggaatcgatgacgacgacgacgacgacgacgacgacgatgacaacgataacaacataaacatggagttcataccccgcgccttatccccaactacaggtgttggagtcgatcctgacaccaggtatctggagaaagatcttgctgaattgcgaggaagtcgtaagaggccccacgagtttctggaggatgtaagcccaaacgagcaaaccaggcaacagctgggactcaggggctgcctgtacagtcttcccaaagaagatatcaaagcagtgttcgacgacaatttcaggcctcccaccaaggacagttttctcacattcgacgaagccttggagtcttgcaaacaacacgcatttcagcatggatatgggctggtggagtgatagtcattatcgcaacttgcaccaaatgagatcggcaaatataatgaagatggccgttccagacgacaattccagtccggcgtacacgaggatgtacaatgagcacctcgactactacaaccaaatgccgccacaaaacaagtggaagattgcgtgtgataaacagggcctaggtgctcgtagcaaaatgcgtcaaaacacctttcttcgatcaaagaggactggttgcggatttcaatttctaattcgctattatgaggaaccatacaatgaattcgccaggggttggcgtggacgatacagagtggaacattcagaagatgacccacgcgacgagtatggacaaaattgtcataaccatcgacccgctgcaacatgttcaattgataagccttaccgtgatcgtgtcttaagcgaaatccgaaatgggagtcatgatattgatattctcgacctcattatggagcatgaaattgcaccatcgaccggattgcagatgctgaggactctttcagcacaggcctatcacctgacatacgacgactacaacgaactgctcaagaagcgtgaaaaagagctgacaggttctttgaatccagcgcatgcgcttatttgcatgcttcaaggagcagagaacaacttcttcgtcgagtacaggaagcagaaccttccgccagatgctgacgacgtggtaaaaaaagggaaagggaagaattctgacgagcaacaaggtgccgatgctggaacagcgtgggtattaactaggggtgaagatatctcgttgcaaccatattaacacagaattgtcacttcttcggtagttgaacacaacgacgatgcagccagtactgaagaacagccggaacagtacatttcagacattttcttcatacacaatgcaaccgtcgagtatcttcgagcatatcctgaggtcattgtccttgactgcagctacaatacaaacagcaacaacatgagacagctgaattttattggaatcgattcctgcaacagatgctttccaatcgccaatgcgtacgtcacacgggaagacgaagacacttatcaatgggcactcgagcagctcaaaaaattcatggataagcacatcattccaatgcccgaagtggtgctctctgactgttgccgtgctattctcaacgcactgaaaaatgtgttccctgagcctaccaccacaccacagttgtgcagatggcacgttaaccgggctattcggaggaaaggctgtatgctttcccggagtggtgagaaattcaccaagttcacgcatctatttgctaaaatgactgatgccgattcccctgagacatttgacaagctctacaaagagttcgcgacggtattcgcgaatgtcaagggccccagcaaagcagcaagcccagatgagatgggggacaatgatgagagagaggagattcggaagtactctcccgtggagtattcgaagtactggtttggtgatgacaacgatcacagataccgggacaagattgtcaagtttcatgttgaaaagtcgtcggacttcttcaatctctcgagctctagagtcgggggcgttcacgctcactacaggcggtacatgagaacaaggagaatgtcgattttcgcatcagggcggcttcttatccgtactaaccttggtttgttggctaatatgaaccaccgacatgcaatgaaaatgtcaacacatgtcatggatcgcaatcacgattggttggacgataatatccaaaagtcgatatcagcaatagcgaagaaaaaggttcacgaccaatatgaactgagatataacgacaatatgaaagaggattgcagtgggagcttcaagtcaagaaaccaacttccttgtgcccatgctgttggcgacatcgccaagaccagggaaggcggccgtctggtactcagagattttcatccccgttacaggctcttccatctcacgaagcagatgacggatgatgagtgggaacaagcatgcaccgtgggagtctatgcagaggagtggcagcaactgcgggcgcgtgaggaacggtttaagtgccaaccgccacccccaccggagccacgaagcatggacattcttgataaatccattgttaatggctcgactccagctgtgcgaatgaagtcttattttgtgatggatgggaagagatatccaaattgcaaggtttgtcaaaacccgtcccacagccatgttaccaagtttaagtgcttcaaagatagattcagcaggaaggatgctatgaagcactggaacaggtacaatttcagcggtcgcaagcacgacaacgagtagctacctcatcgtactctacttgtataaccaaccgatccaaccgacagaccagctgctgaactgggtgacagggtggaaaaggaaccacaacttgtcctgtatgtacaaagggggacttttagtggttctgatttccgtcctatgcaaatactcgaactgtacgaggctacaagtacaagtacaagtacaagaagtacacgtttggagcaccatattgcaaaattcagatcgtcccaaaaagacggaagagatgaaatcttagatttcgtttacaagggtcaagatattgaagctgcattggaaaaaaatctaaaacaaattatggacaaataaactccatccaagtacaagtatagcagccaggacggaaatttcggctgtttttacgcgtacaatactatgcttgtacaaaaagacgccgatgctcctcccctccccctcgttcctgcgtgataataaaattcaaatttcccacggacttttttttgtcccctctttagcttccatgcacggatgttaagtatgaggaaagtaaaataaaataataaattaaattaaattaaattaaagtaaaaataattaagtaataaaaataaaataaaataaaataaaatagcagaaaaaaaatagctaggtatcacgtgaccgggatgaagactcggtcattgttaggccaatatctgaagatgcaaatacctaccaatacgttcttgtaactatttgtcttgatgtctgctacattcagaacaatgtttttggacggaacttggtggttgtacaacacgcaatacagcagggtacagtacgagtacagtacttgtaccggcacgataacagtggaaaaagagggcatttggaccggtattgcaaggacaccagaaaatcaagcctactatcaatcttacggtacaaatacatacattctggtacaactcatacagtatgtactacttgtagtacagtatgttgataaaaggaagtacagtataccgaaaggcacgctgattcaaacaacacaaatatctctgattcgagttgggcaaggactgtcaagtaagtatgaccactcttactgtacccgtaccacactcgtacgaactcatactgtacttgtaccggtacatactgtactcgttcagacggtgactttctgaccacattctatacatgcaactctgatttgggccaacttgggttgaagctgttggggtcactacaaccgctgtctgagcaggtattttccagaaataagatcacttttgtacttaaaaccggctcttctgaatcgattaaactgcctagaaatccaatcggacctcagcaacaccctttccacggcatgtttagctcccgagattagcgtatcagatgtgcatgcagagattggcatgctaaacgtggagtagcggagtaaacaaagcacgtagagaaccggcgaaaataatgaccagaacgtcatatgactcgaaataccaacagcatttcatctcttttgattagtcaacacactcggggtcccgcccccgaccacgtgaccttctccgccccgctcccccgccccgacccacctccgctaccctcgtatatgttgccaccaaacgcgtgaactctgtctccttaccacccaaacactgtttcaacatcaccaaaaatagacagcaggagaacagggacacccagaaccattaacacaacagcatagaccgaggtatagacgaaagcggcgacgacatccacaacattaatcaacgctcacattctttctctctctcacacacactcgctcgcttaggcattacacacacacaagatgacatccaacctcgacttggacgagtgtatagaacgactgtacagaaaagagctgcttccagaggtggtggtggagtctttgtgcaccaaggtcaaggagctgcttgtcaaggagtccaacgtggtgcacattcaggcgccggtcacggtggtgggcgatatccacggtcagttccacgatctcattgaaatcttccgcataggaggatactgcccaaacacaaactacctgttcttgggcgactacgtggaccgggggttgtttagtgtcgaaaccatcactctgctggtgtgtctcaagctgcggtaccccactcgaatcaatctgattcggggcaaccacgagtctcgaggtatcacacaaaactacggcttttacaccgagtgcgttcgcaaatacgatagcggcaacgtgtggatgtactttaccgacctttttgactacctgacgctgtctgtggtcatcgacaactccatattttgtgtccacggtggtctttcgccgaccatccactccatcgaccaaatcaaggtggttgaccggttccgtgagattccccacgagggtcccattgcagatcttgtgtggtcggatccagatgaacagagagcagatttcgcattatcgcccagaggagcagggtatacgtttggcattgacgtggtcaagaagtttctggaggtcaacgacatgaaacacattctgcgggcgcaccagttgtgccaggagggctaccaggtgctgtttgacgaccgcttgtccacggtatggtcggcaccaaactactgctacagatgtgcgaatctggcatcggtgttggaggtcaacctggctggtgagaggttcttcaatgtgtttgatgccgctcccgagaacgaagagcatcagcagatcatactgcaggagtttgaaaatcctcagatgaactcgttgccattgccaaggccggtggagtacttcctgtaatgggctgactacaagcgagcctgaaaaggggtaccccgccggagggatctgggtctccagaaggatccaattgtcgaaaagtatgcactcaccggtccgattacagtggagggggacgcatgttgcatgttgcaatcacgacgacagttcggggtagcgatatcctggctgcacttaatctctagatggaagccatcgtcacgcgaccagtagtacgaaacacaacgtacagtaatactacaagctcacaaatagcatataacaacttcaatagatgcatagaataggttgcactggtgggtggttgcaggtatgagtacaagtacgagcacttcgcgcctttcagatgactttgagcaggcgtattctcttctcatccacatctattgtctcgcagaagcgtagggtccgctgcaaaactccttatgtccgtctttctgaacacggctcaggtatatcttgtgtgtcatacagtaaaagatcttcggtgccatttctgacttggtgaggttgagtgcgagagagatacagtaggtatactgcgggttatcaccaagtatatataccagagggatgaggctgaccaggatattattattgtactgtaggaaaagggtttctgtgcctcaatattctcagagatgacctcaattgatggctccagacgtatggtcgcaccaaatacttgtaccagaagttgccaataaggctggtttgaaagatttaaattaaatagttttaatgtgttatgtttttaaaaaatattctgtactacagtatgtactggtaattcaagatttgggttgaaaaaaaataaaaattgttgttgaatatgttgaaatatgttgaaaatgttttggtaaaaagtcacagtacaagtatgcatgtactgtacttgtaggacgataatcatgaggcgtggactctgtaaaaggagtcaagaaacacaactccaagagagatattcattatgctgtctcatcattcatgtatcagtacagttctggagtgtagaggcggcgcttcagggagtattggtctataggagtagctgtcgggtatcaaagcggtcaaaatagaacatgagggatcattgtgacggaatcaattggtattgcggtgccgataatgatccgagaactgtttcatcttcagggatgtttctttcacactgtttcctattcatcttctctgtggaatgagggtccaaggaagaggtgtaagaacaacagtagatggtatctttactcagttggttacactgagagcttttttgaaacccgaaatccgagattcctagcgtctccagggacgaccagctagtgtttgaacacggctcaaacccatgttttgtataatcatctctcattagctatttacaattcctatcctaggcagcagtctgccttcagtatagtccatactgagctgataatcttggtcctgtattctttaccaagatggcagtacagctcgttcgttgctctcatggactgtgctcgctgtcccttagacaaacgcctgcaacgcactctccaactttgtcttcatttcaagccactcctccataggatccgaaagcacagtgatggcgcctccagctccaattcgccaaatctggcactcaccagtcgactcatgggccgaactttccatggaggcgggatcgtcggcgtgttcccaggcctcggactcatccttgtacgagaatgcagatcgaatgacgactgaccagtcaccctgatcggaaacagaccaaaagccacatactcccgagtaaatgcctcgtcggtggttgttttcgaggtctctgagaatctcgacggatcgcagcttgggagctccagtcatggatccaggaggcaaagagtgtgccagagcatcgataccggaatactgaccatgaagatcgccctgaattactgacacaagctggaacacggtcttgtactcctccacggtcatgagtttgtcgacacgcacgttgttgagcatctggttgaggtcgtgacgaataaggtcgacaatcatgaggttctcagctcgctccttgggggtgttgagtttctcctcggcaattgcgcgagtcatctcaggagtgttcttgatagtacccttgataggtcggaactcacaaacaccatccttgctccacgaaagaaatcgctcgggagaagatcccaccagggtagcatcctgaaggtcgaggaaacacgagtatggagctgggtttcgggtgtacaaaatcttgtacaggtcccaggggttcagcttcttgggaaccttgattttagtctgggcagtgagacaaagctcgtacgactctcctgcaagcaggtagtcctggcacttttcaactcgcttaatgtagtcatcctgatcgggaatagacaccttgggggagcctccagtgagagcagcagaagtggagggaatggacgaaaagagtctatcttttttggcttcgaaatcgggggcgaagaaataatccttgagctcttcagaagtctgtttgatccaagactggtcgtcatcagtgactgagatgacatagaggcagcactcctggtggtcaaaaagaacagatctctcaatatcgacgagattcacgtccggaaacggtctatcggccggagtggggttgaccagagactcaatgttgttggtttcatttgtttcatacgaaaagtagcccaccagacctccataaaacggacagtcgtcaatcacgtctctgcacgacttgaatttctcaatcttgggcttcatgtaggcactgaggtaaccccaaatgccgtcatcgccaagcttaacaagatattcactgtgattgttgtggagctcgtgaggatcatttccccaggtcttcatgaaggcgtgagaagacttatagtcggtgtagtgggtgatacatcgggtctttccctcgtccagaaagcccagaatggaccatcgtccgggaatggcagcagagttgagcatgacaaacttttggttcttgtcgttgagatgctctcccagacaaaccatggtttcagggtatgcgtccttggaaaatttggatcgatccagagcaatcttctcaaacaaaatctcgcccttctgtgctgctgtctcttccagaggcttggcaatggacaggttctggtccgatttggtcagaggggcgggtttgatggagtatttagcggtgaaatcggctaggagagtgtccttgttggcagggtattcacgggacttgttatagtcctgggcaaggctccagaagttttccactagtttccctccgaaatcagagcagatactctcagggtggtactggacgccccagaatggcagttcagtgtgttttccggccatgagaatgtccaccttctttccgtcaatgtcgtctgaggtccaggccaagggctggatcgcagtagattctccgtcctccaacggcacatgcagagagtgatatctgaccgaatcaaaggtgctgggcacgttgtcaaacagtttgtcgccattgtgggtgatctgggccacctggccgtgtttgacgagcttcagtcggtccacattgagcccgttacccaaacacagagactggaagcccaaacacactcccagagtaggcacaatcacgttcttgttgttagagtagatctggggcacacatccgacatcggcggagttctgaggacagcctggaccgggtccaacaactactgcgtcaaacacactgagatacttgtcaaccaactcagaagccggcagcgagtcgttgtgaatggtaatgacccgggatccgggcacggccttttcaatcagcgtggtgaggttgaaggtgaacgagtcgtacgagtcgatgagcagaatattcattttcgaggtcggtgaaccaataccgcacgtttctgtgttgttacagattactagtgtcagattttgaccagcaaagttaaccttgcataacggtgatctggagcgggtaggacggggaatataactgaaattaaatacccaataatagggaaaacgtcggggaaaaaaaaaagaataaatcattgaaacgatggtaaacacaatgaaatacattgttaagtttctacacatctttttcgtcatcttatatgcatttcttgaaaacaccaacttaagcctattgttctcgagagcgggaatagaaggaagccgcagaaagccgaatccacacatatttccggtaaatcaaaagagcaagctacagaaacgtgcttattaagcagaaatgaagacgacacatggcacaaacaccggctcctcggccacacttcacccgttacttgctatttgaacaccttgtctgattggtcatcaagggccactatccgttaacgtgtggcttgtcaccagacttgcacactttgaggctattttatttgcttaaattgtgaggaaggcaaaaaaaaaaaagaacaaatgaaaacacgaaatccagcctgtgccgtgccatgcaatacaagtagcaaataatatgacaagggggacttgtctggagaggttgtttggagggtgtggtagaggaattgagggtcaattggcttgaattgatcaacacgtcttcatggtatttgaacttgaattcttttacaactacaatattatacaatacgagttggagtaaaaactcgtttaaaatacagtgtatatattcatccgactaaatttcggataaacaggactactcaaaataagatttcggatcccccaacaatgcggttcaatttgaggagtgggtgagggggatgtgtttcagagggcttagactgggagcggatgacactagagttgaaaaattggtctgtttcgtgcatttttgggcaagttatagagattgtagtggagtgtacttgttcaactatgtacgataattagaaggtttttgaatttttgatggacaatacgaacacttacgctgggtgttacgtaaggctttttcagcaaccaatggaaagggaaaagggaggtgtccaagggaggtgtccagaaatgagcgtcgtggggtatttggcaagtagtatgaagaggtcggcgatcgtggtcaggagtggtgcacttttttttaatcagttgattcgtttaacagaatctagtgattatatgatgacttttttgaatgttttcggaaaatcagaagaaatcatatcaagtcacagagaagaaatcagatcgagtcacaaaaacacaatcactgagtcaagtatgtacatacgagtagatatctgtgtttcatcaatgtagttttcgaatcgaaaatataacattcaaagtagatgttgattcaagtatcgtaaagtacgtacatactgtgtatcggtagttgccttcacttctggacaagggtacaagtacaatgtgttatgtagtgcggcattcgtactcgcactcgtatcgtacattgttcctgtattcctactggatacatcatataacccgttttaataccgcttattttgtctcgtgccaaggacatcttttttcccccattattccccaattcccacaacaatcctgaaaaaacaaataaactcgccaaaaacaggccaatttaaattacgtgacgcaacacgatacagctgatgcgccaacatctctgttcgtccatcaaccacacctcacaccgtcacttccacaatgccgcccaaaggacacaaaaaaaccgccgacggcgacttccgacccgtcaactcggccggtaacacgatacaggccaagcaaaagtactcgatcgacgatctcctgtaccccaaatcaaccatcaagaatctggccaaggagacactgccagatgacgccatcatttccaaggacgcgttgacggccatccagcgagctgccacgctgtttgtgtcgtacatggcgagccacggaaacgcgtcggccgaggctggaggccgaaagaagataacgccccaggacgttttcgtggcccttaaggacgttgatctggctcagtttgtgcccagtgtgacccagagtgtcaacgagttcgaacaggaagttgcacaaaggaagaaggacaaggttgtacgcgcccaggacgaccaggaccatatttccagctcagagtcggaaaccgaggcgacagaggaagagggcaacaaaagaattagaactgatgagtagaagacgagaaggacaacgtggcaacaggacatttagatgccatactgaaagatgcgaacatactcaacacgcagctacgtgtggtcaaggtcacaagcagaaagccctgattgcagtcaaaacacactctccacctggcgcaaaagcacaaccgacacatacgttatcgcacgataataaccacttacatacatgccgcaacggcatcaatacatgcacatttatttgatacacagcaagcctactgccgtgcacttggggcgggggtgtcttagatgccccgttgtcattgccagaacccacgatgtaaaagatctggacagttgcccatattgaataatgagcatgtcttgattcgcgtcgtacagcacgaccagactatatgttctggtctctttccggtgactcgagcctgtttgtcatcccaagagcgagctgacgagttccaccaaataaggcagcttgtacttaatggtaatggtcagatcgacagctcaaggccttttggtaatcttggagctcgacgggttgtcgtcctccgacttgatggcgatatcggaaggaccgttctcgttgtccttgacattgtagccgtgttcatcgtgtactcgaaaagaagatagataaaggttgatggggatcttcagggaggatagatgtattcgatgccgagaatagttcgtccgtgatggccttcctgttgtttgagccgattgtcataagtgtttgaatacacgagcaggatcgagatgaatgactgaacacacttgccgcagtggaagatgaagatgcctcccaaagagtgtgacttgatggcacttgtactgtactggttgctggtatcatgtagatatagtaagaaccatgggcttctcaccttctcctgagttttttgtaaaccagcagaaatcagctcacaatatatagcaaacatatgtcggcgaacagactacggagatactctacaaccattgcgttacattctattatacaatacatcccgttctttcttttaagccatctcaacgtcctccttgacctcttcggtcacctctgcggttgcgctcttggtctcctcctttaccccgttctctccgatccacagtacgttgttgcatctgatgaaaacgtcgcctagctcgcccttgttctcctggtcgacatactccactgcatcctccagctgcaggttcatataactgtcgacggaaacaagtgtgccctggtactcggtcttgccccacttgaggtggacaatgacggacttgcctgtgagttcttgcagaaacggtttggggttggtgggattgaaaggggttgactgggttagtaatgatagtagaggagatgatgtgcgtggcgacgacagatgattgtgggcgaatcagttgtgaagcggaggttaactaagcatggttgaggagagctagaccacacatgtcactagtgtatatgcggttcacctcgttcgagcgagacaagagcttgccaaggagtcagctgcaaattggaccatttccagtgcctcactttcccctcattcacggttgtagaaaaacgacattccattgctgtcacaccacacaaacacaaacaacataaaaattgcatgactttcacggcggactcttgatatggggtttctcggaaaaggctttgcgtagcagacaatatcaagcctagacgcagcagtagtgtcaccgtgtcgtccttccattcttgtagatgttgagttgaatccaactacaaaacgagagatcagagacacaagaccacaaatacttgcagtccatacctcggtatccataaccactccaataccccgctaggtacgccactggtccagctcttcaaacagcattcctgtcttgacagcatcagacctcgtcagtatatggtcccctctcacaccccgtccctctcacaccccgtcattgtgtctgcctgactaccaataacgcatatccatcatctgtagcatttccactgctcaaaaaattcatactcaccatccttgttgtggtaaaatgcttgttgtagaagtggtgatgatggccgtgatctgagggtctacacactgatactgcaaaataaggtttcctgaattttgaagaaaaaaaataattgcgaattctgtggatcgaacacaggacctccagatttcaagactgagaattacttcagtctggcgctctcccaactgagctaaatccgccgcgatttcgatatttttggatcaatctcagcagtcagcattgtcgaattatgtaatcatgattgctgatatatttaccggtcaatagatgaaacaagaagaatacgtgaacaaccatacacgaatgccatgcgctcttctggacaactgaatccagatccgatttgcaggtataacagatgtactcaagtagctgatgtatttccccagcatgaaaaaaaaaaagaaaaaaggataacataaagtcctctgttccctgtattctaatatatctttctgcacggttacgacagtgtccataccttcaatatggccaccatttttttatattctactttttttattttttattctaatgattcctttctactgcggctgagtcatcagtctgcttagtcagaggtctggttataaaacgggaatatctccaggtcccttggcccagttggttaaggcgtcgtgctaataagaaatagccactttgcaacgcgaagatcagcagttcgatcctgctagggaccattcctttttgctcctttcagaaccgcagatggtcagtcgcaagcgcttcctgtcctgatgttgctatctcattctcttctaaatggttgtgagaagagaatgttatcggatcggacccgctgtgtttgcaagcaatgtacaaatttccatgtggggtttcattgaagtcttgataaaacccgagaaagaagacaatggcccattccaaagcagtcaatggcgtctattttgctacttggagaaccgatagcccccacacgcatttcacggttggctcccccgcgtttctcgtcgacgacggaaaggtccgaatctagtgctagcgtccagggtatgagcatggctcccatgtccggttggatatatggaattgctgcttactaaaaggaagtgtgtttatgagcgatgaatggcctttcgggaccggaacttccagatattgctggtaactgctaatcgacacagctctcgttcacgctaatgagtggtgtaatctcgtgagttaggtagtaaatagcagtacagtacatcttgaagttgtcgaactggtgaaatttgtaccttttggcgaccagttgccacactctcctaggtcgaacgagaaagctcgggtcgatagatgggttgtagttcgatctcttaaaacccgtttcgtgaattactctgaattctccaactatcggatcagagcctgggcctatttgagccacttcatgtgtatcgtatgtgtgtacattgtagtcatcaattcatccgcaaggatcgcggttgttctccaagtacgggtgcggactggactcgtatcacaccgaaggacagagtggtgggtatgtttaacagttcagtgcaacgtgaaggactttcaaggacgactctactaatttacaactctacaactcaagaactcaagaactacacaacgacaattcaccgacaattcaacgacccggctcataaaaaacaatccaaccacttgataacaactcaatcaatccaagggacatataaaagtgcacagtacatacagtactgtacatagtgtacgcaatttagccgtatccgcagtagattatggtaagtaccgtagtcgtagtacgtatatactaccaaaacacctcacaccaacatctgacgattgcatcactcaccagactcgagcactcctaaaactgacctcatgcacaaccattttctgcccataccttcaactttcggcgtagtccgacctcgttcagaccgccgtgagtgtcagagtcacgtctgagcagcacactaattagatcaacgcgtcgcgccaaactttaacggagccgcatgtggtgaaccccgcgcggaaatcacataaaaagataaataataaaaaacacctgatctgaagatattgtcatggccaagaacacggattctgcgactcccccgacaatgtgacttccacaacagcgaagacagacttgggtcggggtgaggtgacgcgcgaatataatgatctcgccaaatgtgatgttcaatgccatgtcaacccgattatcagatcaaagtgcttctatctggccaaccttgcaatgacaatggtcaaacccccatccatgtcagaaacgggcattttcgcgggccgagtcgctccgtgggaaacatgacgtgtctgggtcgattggagtatcgcaaatacatacaaacgcggcttgagtccactcgacgatgacgtagtggacgcatattacgccgcattgttaaactcaacatcgtgaaaagtaaagtaaaagaaaatgaaaaataacaaattacaatgggaaaaaataacatccaccgacacgcgaaaggaaaaaatgagacttgatgagattcaatgaggtccgatgaggctggattgatgcgtggaatcaccaaccaatcgttgtattgctaatggccgtgtcgactttctgaacacaccttgtctcgctgtatgcatcccttgtgccatttcagccgcacagatcagaagtgtatgacacgccgacgattccatgtcacaaactccacaatcagtcatacctacttatatcaaataaatagcatcattaccgtaattatacgtgtgtacggtgagtcagagtcagtctgaggcagccgagcgtccagtccagaaaatagtctactttcccttatttttcgcacttttttattatgctcatctcaccacaaactctaccccaaaccatatatttatcgccgtttctctccacacataactgcactcgcactttgagacatccccccaatcaccctctgcactacgccatgtctctaatacactccaatgactcgtcttccgtctggctggagacggtgtcgagaacggtcaaatgcattgtgtccgtctactttcgccaccacgaggcggtggagtttgatcacccgctcaagtccgaagccagtgggtttgtagtcgacaaggagcagggcatcatcgtcaccaaccgccacgtgattggggccggcgtcttttccggcaaaatcaagttccacaacttcgaggagtgcaaggtcgacgtgctctactgcgaccccatccacgactttggttttctcaaattcaaccccagcgacatcaaacatgtcgccattggagaaatcagcctgcgacccgatctcgccaggatcggcacagaaattcgaattctcggaaacgacagcggacagcagctgtccattctgtctggcttcatttcccgagtccagcgaaacacaccccactatggagaccacacctacaacgacttcaacaccttttacatccaggcagcagccaacgccaagggcggctcttcaggctcccctgtcatcaacattgatggccacgctgtcgggctccaagctggaggaatgacctactccaccaccgactactttctgcctttacagcgagtcaagagagctctcgatatcgtgcgtcagggaggtctggtcaccagaggatgtctgcaaaccatctgggagcacacatcattcaacatttgctcacattatggcctgacagaagacctcgagggccgaattcgaaagaagtatcctgataatgtcggcatgctggttgccaagcatgtggtcaaggacggcaagagcgacaagaagattcaggttggcgatattcttgtgtctgtggacggagaagacatcatcgacttcgctgtgttggacagtattctcgacgagtctgtgggcaagtctcattccattgaagtgttccgggactcgtctcttctcaagtttgatgtggaagtggcagatctgcatgctctctcttgcactgagtttgtcaagttcggaggcatgactttccataacatgacttatcagcttgtccgatctaccaacgagcccatcgatggagttattgtcgcttgtggaggccccactgatgtcaactgtcggtccaagctgtacaaaatcaacggcaagaagatttccaatcttactgaactgaaggagttcttcaaaaacgctgtgcatggtaagtcctacgcgtttgagttccgaatgatcaagaccaccacgaccaacaaccagtcggtgcggttcgatctgcatttctaccccgatttcgtctgggcccgaaagactggcagtgtgtggactatggagaagctcattgttaacggtatcaagaacacaactattcttccgtcagttatcaagggtacgagcgtttctcagatcgaaggagttcccaccgaggtggaagggtctgctgctgcttctgagaccgttctctcttccgaggcagctgtcaaggagcctgagactaaaattcccacagttttactctccagtatttcggatattaccgctttgtccttcgctaacattctgcagtcgtttgtgaccgtcacagtgtcacggccggtcaactgtgactctgtggaggctgttgagagcggacatcactctgatgaagagtaccagaagacggggtacatcatcgacaaggagctaggcatcattctcaccaccaatgtcattttctcgcacttttctacgctgtacatcaccttcttcgaccaggtccgtctgcctgtttccatcaagtacattgacttgcagcagaactttgctcttcttcaatatgatcccagcatgatttctgctcctgtaacagaactcaagctgtcttccactaagaagaataactttgctattggcgaaaaggtgtactcgttccagcctgaccccagcaaggctgtgtgctctcgcatggagaactcgattctaaacacccggttctccaccgacgttggagaaggagctgacactctgcttgtggagcgggagctggagaagtatatggcctatggtatcatcaccagtcccgagactgacgaggtgattgctatggccggaagtcccaacggctggagatctcgaattcgaggtgtctacgaggtgcatcgagtcctggagaagattcgaaacaaggagccccttcctgagaaacggtttattaacgtctacttcaccaagactaccctcttgcatgcccgggacaatggtctttccgaggaacgggttttggagtgcacgagtgacgaaggcagcggcagtggaggggtctactctacggtgtttgcttctgctgatactcctttcaagagtggagatattctgctcaagattgagggcaaaaacatcaaggaggacgactttgtggtgttttctaccctcgaggagtttgaggtgttgattctgcgtgaccacaaggagctgactctcaaggtgaagacgtctcctgcgagtgaacttcttacttctcggctcttcctctggtgcgacaacgtcttccagaagccgtggattgatgttcggcagacccatgccactgaatggccctcggagatggtcatctttcccgattcggctcaactgagtgatttggagcaggacaatctatgttttgtgacccatgtcaactcaaagccagtcaagactatggatgatcttcagaagattcttctggacatccccaacggcacatacgccacgctggttcttgaagacgacacttcggggcctcggacaacttccatttattgcaattacgacaccaatcctctggttgagtatgtgcgggaaggtcgtcattggactcgaactgagtatggtgttgcagagacgcgggtaattgagtgggacgagtggactcctgggtctggcaagtcttcgttgtgatggagagggttgcatcttgtaattagtatggttttatgtagtaatgtattttagctgattaaaggtactgtagtacacgttttatacacatttatcacgagtaggttctaccatagaagtactacatccatatttcatattcccgctattgtctctaatcaagccatgtgttccgtctatttattagtttaccatccctctatcgttagatcaattgtctcctcctacttaagcaatcttcttactggcggagacaaagccgactcccttaacggtgcagatcatctcgttttcgttctcgtcgtcctccttgagacgcatttctacgccccaaaacttcttgatatctcgggcgagggtgacgaaccgttcgtcaatgttctgttttccaatcaccagccgtccgacatctccggatcccagaatcatgaagatgatggccatgtcgagctggttgcggccaaacacgcccgctctactgatctcctcaatgagctttttggcggtttctcgacctagatcctcaggaatggagcctgctaccgccaccgactcggccgaaatgcaaaatccgggtctggtttctcccacaagcacaataccaaagccaggcgactttccagactcgtctcctcgagccacgtctgagaaaataaatgtctcgcaaccagtggctctcagctcctctctcgctccatcaatcagtcggttcacggacgcaggagacactcgacacgagtatgcaatgcctctgattttggatatggtgggtgtggtggtggcatgaagggtctttggatgtagcactaggtgcggcaagtgcagcatcacctctcctccaccaaggggagtggctcctcgctgaatgatcttcaactcctgtctctcaataccaaacttctgcatcacggggaacacggaggttcgaatactgtctggcgacgggtccagagaatgcgaagtgataccccgaagagtggcggtcagggccttcttgccaaacggcgcaagaagcagaagaggttcaatgaagtaccccactcctctactcagggggcaattatgggtcacagaaccacccacaatgattccgggcttgaaaacaaccgtggtacctgtgtaggagatttcaaaaaccgatccgttggtgatcgattcaagcagacgtagaaacgacacctcgtagtccttcacaccgggctccacatcgtctgaccggatcttgtcgattcgcacaggcatgcccgataacgtggcgagcacgagccgccgtcggaagttgttgtggcccgaaaaatgtatcgtttgtttctttgccgtcgacatggtggtttgtgtagctagtgatcagcatgctctgaaatatattttttaaacacccttcatgcataattttttggaataggctttacgttagagtttaaccgatggcttcagttcgattcgcggtggtggtcgaatagacgcggattggagttgatgcaggtagctggaaaaagtgtcgggggagggggatatccagtgcattctcgctttcttttacttccgcctggtacaagattgccctttttggtgttgccgtaatattggttgttttattttgttttatttgttttattgtttttttaattgtttaattttttaagctgatatcccagctgtaattatccttacttggggtttttaaaccagtcaagtcatcatattgggcaatcttcctcgttcatcgttcgaatcctggtcagatcggactgagacgataaatgtttggacacccgttttttcccaccggagtcacaagtctctcgttcctcttgcacagtataacccgttttgcttacattcgatacaaggattattctcttagatgatgttttaattaatgtattgaaaatgtattgagaaaaatcaatagctgtttgcacaaatggctgagatagcctttaacgccaaagtcgagctgaacacttttcctccagcattttattctgttgacttgcgttctcaccagggctgtcttggtggcgtgtcagctattgaaaatcctaagtattattgattagatatagttaatataacgacttacagctcacttctagggacaccacgttctgatagtagcacacagaagggtgtgtgcttgctcattcacgacaagagattgtagatcagcggatacacatctacaggatggacatctcgtctacgaccaagctggttcctctcatcactattgacctcttatcattatgtgaggaaattagccaggtattaccctaccgggttttaccttccccttgcagcatgtctagcgataatctcaataatccgtccgcagtcgaaatcaaactggagacatctgctcttcaggaaatgattacgcagctgccatgccgccgtaggttcacacgacgctcccgaacaggaaatacgaaaaaggcgcatctcattggagcaggctagggatcaaaagaataaagaagaaaaaaaaagaagaaaaaaaaagaagaaaaaaaaaaaggggtgacacactcatggactgcggcgtattgatcacagtttcaaaacaactttggtgtaatacagtccccctacaagtagcacgatcgcataggctacaagtccacattggtctgggctacaattgtagcatctggtatcgcaaagtacacccgtagtgtgacccggctacagacggtgagttagttagtgtgtctctgagcaagaaaaacaaagatggttacgagacatttgttttcgctgccgtacttagctcacgagacatttgctgccgtagctcgcgagacatttcggaacattttgggcgttgtgcacagcaaagtgtttttggatgtcgctgtaggagggagtgcatcacgggttgtggtcataacttcagcagaataggaggtatagcaaggcagtgtgacgccttatagtcgtggaaaacagttggccgtaacgttcataactgaagcaataaatgataaatgccacggaaaaacaaaccgcccataggtaggacaaggtccatgtagcaaagatcgtatgacagtaaagggttgctacatgggaggagtagaaagctgtcagtgggaaggaaaaagaggagctgtgatgacgtacaagtgcatctacttgtactgcactgcacatactgtacttgtagtcggtctgtggtggagacgggaaagacagagcagtgcatcttgtgtgtttgagaggtggtgcaatagatactttggttgtatcgtagcggtcctaaagagcaggtgcaactgctggaatcatagattgaacatagagagtggaaaaatgcaacgataccacgagatatgagtgtcgggagcttcttgtggtgacttgtcgttactttttgctgttgttggactcctcatcttggcagccctggtatgagctgtaaatgtcatctgttgtataaccatctgtcgatagcgttgttttgtccgatccgtgcttggctcgaaagccaccaggagctaaggacatttgctaattaatgaaacgaccccagcagctctggctccaatggcccggacgttagtggtgagtagccctgttggtggtttggacacgccattccctgggctattccctgggtcctccaacgtctcgatgttagccagtcagcgttttcttgtttgggtcttggtcatttctttttcacacacctttttccgctcgcttttcccgcctctctttgcactctgctgctccctcgccccgtaattcggattaattgcaaagcctaaaaaccacaaaagaggcactgtgtctagccccccagggcaagggtcgcctcgtacaggtaatggccaaaaacctataagccgcatcagctgggttccccacacctgactgtgcaactcaaaaaaaatacaaagcccgtgtggatactcttgtgatgacgtgggcatgtgcacgtacaggagctactgtagcaaccgccgccaccagctcgcggctgggtctagcgccacatggcacaaacaccggggttagagcgtgggtcaggggctcgttccgggttggtcggcagatgggcttgttgtggcagaggcaccagtggtggacgggggttagggccaaactagtttagtgcgcggtttggacatgggtcggggttggtgtgtgtgtgtggaggaggaggaagataagtgattgggggtccgatgggcttttattgtcggcgatttctactctctttttataaccacatgatacattaagcgtctctagcagttcccctcgttgtgctgggaaagcgatagacgaacaaccgtcaaaaaagacccgactggtaataccagtataaagttgaccaatcttaacgttgattttctcataccaggctacgagtaattgtcagacccggtaatttaatttagatttagggtttctgaggagtgtactgctccaccgctgggtcaaaaccagtcacgacagtattactgccaacatcaccagcagcgcgccagagttgcagacagagcaagacaaaacccgcatttgcgccagcgagcactcccgacgcaaccaagagccccatcacgagaccgcacaagtttgagagcacagcccagaggcatacacacacacacacacacacacacacacacgcactctcgctttgtcacaacagcgtgtgagcgccaccaaattagcacccggaacgttaccgacacctttccgatacaccagtggttctacagtacagtagcaggttgcgccagccctagcacataaaatggagacggattccaaacgcggcgtgtactccattgcacgatccatgttgccgcagcattttctgcggcgagccccccacgaggactacgacattgagcagcacctcaacatgagcatgtttgaggacgacgacgggctcaacgaggagctagacattgacatggatcagttccacatggacctcttttcgccccagcagggcgtggtcacacagaccccgatacccacgccgatacaaaagtctccggcaacgcttccgacacattcgacacattcgacacaacccgccacacagacacaaaaggccaagaaacgcaaaaacgagtccggcctggccaactacaagtttggccgaaccacgcccatcatttaccccccgtcgttgagccctggcccccacaactccggctcgccccccacctatctgccggacttcaacccggtgacttgggaccagattggcagtcacaccgcccacaagcttgtggtccaggacctccctccccgctcgcgagtggagacacaaatcaacctgtccatgtttgtgtacccgccgccaccacagaaccttgtgcatctccccaccgacacaatttccaaacccaagctgcagctgcgacagggcttcgagcccgacgccgacgtgctcatgttggagacggtcgtcgtgtgccattcggacccccgcaacttcgtcaatatttgttctggttgcatgaaccgagagcgaaagcgagcgtcgcgtaaaaaggtgcgtgtccccatcgacgaagcacactggaactgcgaccgggaccgacgcgccatcatcttcaactgcaaagagattgtcgagctgtcccccgtgaccaccgaaggaggagtggtgggtcgacggctggatctgcccatgcggatcgcgtgctactgtcgccaccacggcgaggagctgggcttcacagcctacatttcgctgagggaccacacgggccgtgttgttgcccagacaaaaaccacccccatcatgatcaccgacgaccacaaggccttgaccgagggcgacgtgtcctctctagcagctcgagtctcttccgaatcgcaacaatcacaatcacaaccacaatcacaaccacagtcacagccacaatcacaaccacaatcacaggcgcaatcgccctctcccgatggtcctcagatggagatggaggtggttcgaaccaccaagaaacgtaagagtggcgccgacgacacaccctactccatgtcgtcgaccacgtcactccagaagctgggctctgtctcagaaacatcttccattcccgacacggatctcttcacgtctgtgccctcatccaccgacttctccgagtcatacaccaacatggccagtttgttgagtgggtccgagagtgcggcggaggaggattcctctgtccctgccgtcaagcggcttattccctctcagggctctatccggggaggtatggagatcaccttgctgggccagggtttccatgacggactcgtggtgaagtttggtgacaactttgcctcaacccagtgctggagtgatacgaccattgtcgcacagcttcctgccactgaggttgccgggcccgtgattgtcgccttctctggtatccccgtcaaaaacccccaggtcttcacatatatcgatgacacggaccgacaactcatcgagctggctctgcaggtggtgggtcttaagatgaacggcaagctagaggacgctaaggacattgctcgtcggcttattggaggaggaggagtcaataacgtttctggcgtgatggttcaacaacagcagcagcatcaacagcctgactacattcaacagcagatgcagctggagagcgaggtaatcaagctgctgagctgctgtgacgtgatgcagagctctgaaaacaacgagggcctcaacttcaccaacgccaagacgcagtcgatgatgcacctggctgccggactcggattcacacgactagtggttttcttgacctctcggggcgtgttcctgaacacccaagacgacgcgggctttaccccgctgcattacgctgctcttcgtggcaagctggatgttgtcacgtacctggcttctcagaacgtcaacctctttgtggagtccaagtccggtcactacgcgctggacattgctgaggaggagatccggtcatatctgatggatctcatgtactcgggcgtgtctgcttcttcggatgactctggttcagagactgaagtgcccgcatcttccaagcggtcgcgtcgacatcgacgacgagcacgaggaccccgaggtatcgctcagtacatgtacgaccttaacagcgcggtgtggagctccaacatgggcgatctgtatgatttcatcaagtcgcccttcaaggtcgctgagtcatctacgtcggaatcgtcttccgcgtcttccgcgtctcccgcgtcttcctcgtctcctaacgagcatgctcctcccaaatacgaagacatctttcccgagggctccaaggtgcccgaaatcgactactcgtcgtcggtcattgaagctgggtcttccaccccagcagcccccagctcgtgggaccgaaaggagcagacagaagtgtctgccactccttctaacacacccaccgatgagtctgctgcttcctgtggagcagtagaaatgagcgaggaggaggtcatggaggcctggaagtcgaagcgtacgcttctgcaccaagacattatgttcttcctcttctggcttcccatttttgttgctctcatgtactgggcctatctgaccgctcggtcctctctcatgggctactcttcgacatcttcttgggatgtcaagtctatgaaagacacttttctggactatactttgcatgtcctgattcccaagaagcacattcacaaagtcaagtggttgagttgagtcgaaaataatagttgcatttagacaagtgatttattgagtattttcggtgttttgtaaagagtatgatttgttctattgtacttttggtgtaactaaatgtacagtacagtactgtgaggttgtaccacctgagtcaggggcgtattatttaatttttaattctaattttattctttcgtttttccggaatttggctgaataatcatctttgcgccgtcatagccgccttcgtggccaagtggtaaggcgcagcactagtaatgctgagatcatcagttcaaatctggtcgaaggcagtaaatttttgttccccatcaaagaaccaatggaggaggattttttgggaaaaaaatatttaaattttaatttaaaaaagcccgacgtggggcttgaacccacagccttgagatgaccttagaataagagtctcacgctctaccgattgagctagccaggcgattttcaaaaaaaatgtatcctgtattatttatcatgaaaattgtcaaaaatctcgcgaattgatttataattgatatcagaatatttatcttgacttcattagtacccttctggcttttgtttggactaatgggtaatttcaagtctgttgtgagtccagaaaaaggatctacaaactggttcaaaactgcacaaacggatttatgactctagagtcttccagcagtgtgataatggaatatattgtgatcttgcagaccgtttcttctaaggtcaagactgttcctatattgtctttatgagcagtactttttctcacggttgtgcaattgacccgaacctggacggatcatcactgtcatgttctgagcgtgtacaaaagtgtacttgtactatattgtggatatttatgtattgtggctgtaaatactggttctgttgagcatttttgagaccccttgctgttctcctgctggagcgaaaagttttagttgggattatggtctgattagttggtacttccagcattcaggtatagctgtcacgatagacattccacatctgcgactcaacactcgcttttgcaactcgatttgacgagattaaactagtccgcttttttgagagagccctttgaagacctgaagggatttcacggcttcaattctggtgtctgaatccattcaacgaccatgactttagtctctctgcacttcagatgtctctcgacaagtattggcagagatacttatagaacacttgatggtgctggcaccgttgacaagtccaatatcgtaattcgaataatctgctaggaagattaatgcatggttcgtctaaaccaccgacatctcgtgttcctcatttcaccttggtccacacatccacttcgagccatgcaaccagtctttcccctggtatccgccttggtttcccattttgagtcgatcgcctcgtaatctgggggtgctagagactcgtaggaaggagcagagtcatcggcgtaatcgtttttgaagaccatgtttgtattctttaacagggggtactcgcacagcaaaaagtcttcatattcgaacggcacgaggttagagcaagcgtccacctgagcggttccgaagactgaccgcgctctggagaacaccaaaggcgcagacagagacaggtccacgtaccttcgggacttctgattgggctggttggtcatatccaattgtgagaagcgcagcgacacgtatatcttgtgcaccacgtgaagagggtgggtgcgggaggttgatgcggataatttgtcaatgatccgggaattcaacttcagcgagtaatccagcactgtctcttcggctccggggatgagaagattgcctctatggatggagtcgaaaaagttttccttcacgtcgaacccttcttccctggcttgctggagttctatttcgtcatgctctacatcgtccgaatctgcgtatcggttggaatacacggtgaggagtccagttttctgcgtgtcattggcgtttgaattgcaggtttgggtcacggagatcttgacggagttgagtcgaatgggcttctcaaacagggtcgtggtgatcttgacggggatctcggtatcttcgtttagagaaatgtctttctgcgggtaagaaacaacgaatctgagcttgttgagccagggagccgagacattgacggggagaagagtctggtcgtctatctttctgcctcgggctatgacaatctcctgggaatgctcaatgaggccgcagtttgaatgtaaccgcttttggcagctcacctgggtgtcaagagtgtaccacagtttgttggagttgtgggaagcagtttcaggaagcccagcaggaagagagcagtgaagcgagtacttgtgagtggaggcttggatagagaccggattggagattgcagaaacgggcccttcaacaggcttggatcgacccgacaagagatcccattggaccagagtctcgttcgtttgagcccttgtctccgacactaccatgtgacgcactagagcagtggtcatctttttgacccgcgtgctcttcgtgtacttcactgagacaatgggggtaaagtccaccatgagtgatctctgttcctgcatgacttgttcaaacgaaggtaaaggcgagtcggaccggggaagagagattgttgtctctgagagagcgtctagtcctgtggtgttactgctgtgtgatccataatcttcatcatcctcatgggactcttctgctggtgcgtaaggaatatccaagtgggttccctgataggagatgaggacagacattttggtcaccagaacaacgaccctggacccgctttatctatctatcgagtgaggagctgatcgttagcggctcttgtttggaacctagacagattagcctccgactcgctcctcagagctttccctgttgttgccagacattcatcgttatatgatacaagtacgaggtttgtctgcaacaacggaattctaatcttcctcaattgatttcttttgtccaatgtctcctttactcctgctaactggcaagcgactgcgccatcgtttcgtgtgctctgctattcgcgctccgtctcagccgctgcgtctttcaaccagacatcgctcaacacggtctccaagcagacataaccaaagccctgataactttgagactctgagggttcgcaatacgatgtccgattctgcatcgagttcgaaaagtggaagcaaaccggcgggataaaaggttcagccgcaagataagacaccaatggcggtgaagggttgtctcggcgaagctcaaggttgttccttttctggagctctgtagctgcccttttctcacggtaggggtgtgttctgctcctgtgtcgcacagcgtacgttgggtcgctcaagcgttcgatcgttcgatcttctcgtcccgctccacgatccaaagtgactcagcgtcgcaggtatggctcacaatcgacgctaacccaatggctattactctctccgcttgggctaagtgcggcttagaagccttagctcctagtttggcagagatgtgttgtggatacctgcgtatgtacagtaacggaagggatgtgcggatcaggaccttctgttgctagttcccccgttctgtatcgcacagccggatacaatgattgaaggggctgtgggcggactatctgtccaccgtccaaagagctaccagtagctctattgaacattcagaactgtaaatcacttggtggcaattcagtgttcataccagggatcgcccttcttattgaagttgaagtgggtggcaagtgcctaacgccacccggtagtaatctgctccgctgggacgtcgtcagtttggggattccagcggtgcggtcagggtagatgtcgatgttacctgcggtacttgtacatttggaagagtagattgatgacttcatatacaagtacgagcacagtttcgtatcgtacatagtgcatttgtacttgcaccggcacgatagtggaatgtgtgactgtttctccacggactctgagcttctatatagttgtcgccgttgttcattgtcaccattgtcctgtagatttgccaccagctcgtattcacccttaattggggatattccgaatacctcgggcgtctgctgaattggtggatagcggtttgagataacttggagacgatatgctccattttcaatcgcaagttcttttcgtcgagaacacgagcaggtattcttttttaattgtaagaagagaagcccaggatggggggggagagaaagacggtccggtcagggaaatggaggaatgaggttgggaaaaggagaagctgaacgaggatatctaatatttgccgttttatcgctttttgctgtttttttgccagtaatttcgccagtaatttaacactttttcacgtccaaatggatttgaaccgctctttctcgggaaatacttttcagctgcttgaagcctgaaacctataatcaatattacatcctcatatctgttcgcattcggttttttcagaagagcgcttttttttattatgatattactatttttattctattactatttttattctattactatttttattctattactatttttattctattactatttttattctattactatttttattctattactatttttattctattactattttttattctacgttatttattctaatgatggttttttattttttatttttttaattattcatcacagctatatacctacttgtagtaagccgggttattggcgttcaataaatcatacacttctgaatcattgcggtgtgcgctgcgaggcgctgtcagttggtttgtcgacgcttcgtctagttgtcttcatgactaatccaatgtctcagttttccttttcaatttgtccttttctcagaatccggtcccttggcccagttggttaaggcgtcgtgctaataagaagttagcctctttgcaacgcgaagatcagcagttcgatcctgctagggaccattctttttgtttttaatttgacagtagactgaagcagtggttctctcccagtccaacgttgacttgtattgtatttttattcgcctaccaactttttgctttttggatacttacactgtgtggctacagtaaaatctcaccgcagtctcaggggagagtgagaaggatatacaaggacttgtacggtacaatgcttttacttgagatattgtagtgactctgaaccctcagccagcgtctgttgtcgatttaaacaaagtggttttttttcaagttcaggtagatgaacataataggactacaactacaactacacactgtacttgtacaagtatagaggtgtggatttggacgcataacgggacacaagcccagtcaccccgaaagcaaaaaaggatacaaatagccaaccccagcccaaagcagagtctcggaacacaaaatccggtaaaattaaacccattggacccttttaaaggactttttcactcccacactcagctcatcgaccctgcatatccccaaactctaaccgactcggagaacaatacaaaagaattatgaggagagactgtttgtacattgtacttgctcaagcacgttgtagccagcgatgactaacgggttttattcaaatcatgatgatcattacaagacaatgatatgtactatacttcaatatatatatgtaggttcaatatcgaactccaagtctaaatgtgcaggatcctgtctagtggagccaaaaatctgtgctgaaaccaaccagaaatatagccagagacaagcaaaaaaacagctggaccgcctagctgcttctcactccgatacggggaatcgaaccccggtctccacggttctcaacatgagagcgtgatgtgatagcccctacactatatcggataggttgtttttttgttagaaccctggccccgtgactaagcagactgatgactcagccgcggtggccacactcaaggtatggtcactaccgtcactctcaagaaaggtatattagaatacatgggatacaggggtttatatgttatccagggttgcggtgcaaccctttgtccatgatagcaggcttgacatatcgatattaatgatagtgtaatcccactgagggcccacatggtggcccctcgtcatagtctccgcggagtcccgtcgggactccattagcggttcacgggtgactaatcaggcgatattttcttagtcgctgatccccaacagtgttgctcctggcacaggtaagcgcctgttgagcatggtaaaatcgtgtcgcgtggtcttaggatgcctcgccaggtccgtggtagagactcttccactcctgttctaacatataataatggtaaggagtgaatcggtcggtcaatagtttggtgaagtcattccaagtcgtgggcttctgctccaagtcgaaccaccaatcctctgctgtgccgcacatggccgtgacagcaacagcgatttgaactgactcggggatgccgaaatggtccattctgttcttgatccgtttcgtgaatcgtcggacatcggaaccggatcgtattccctccccgttaaatttgggttcgaagtctttgatgtcgcactcccggcagtagtctcggagggtctttgtggccatattggatgtgggtattgctttaaatacttgttgtcgaacgtctccgaatgtgtgtccctgtcggaagacgtggtgctactctgtcctgaatctccagtcacgaacgcgttgtcggaagaagatgggagacagtgatagcgtgtagtaaaaaactttcagtcgaatcggaaagagattccacgtagggctcaatctcgatgtcttgtgcgcgtcctgttagatcactcaatgatgtgtgtctcgtgatgtgcagtgaccctgatgtctcggaaaaaaccagaattcgccaccacgtgtaaccgttcaagctcacgtctcttggtcgtcgttgtcgtaagtattctggcgtgtgaccgtctcacaccgcgctcgtcaaatactgctcgtctgcaatatacttcatatattctcccaaccgcgagtccgtgtcacaggtcacgtgcctcctacatgaaccctaacccggacgtcacgtgccttacacgagatcttgaatgggtgattcagcgctgaggatgcagtgatcaagtattacgagatggccaaggaagcctctgtccgggaagcctgaagtagacaagaatgagtacagtaggcagagaagaccaagcgagttgggctgaagaaggatggggggttcgagctcgagcggcccaggagaaacgagaagcaaagcaacacgcgaaggaggcaaaggaggccaggaaggcaaaggaggccaggaaggcaaagaaggccgagcggaagccaaagcaaaggtctgagcagcagcaaaagacgtgggacaaatatggctgaagaaacaaagacctgctgaagcagaggcttgcagaaagttgctgaattgaatactgaagtcaagaaacaaaccgttggtacagtagaaaccgcacccaattcttcccaggatacacatgtttccgacccgcaggctgaggacgagaagaatgtggactctgactctgactatgaagactggttgcggggaaaactcgagatcaagtcaaagccggcagtcaaaaagagtacactgacgcagccttccactgaacctcctcctaaagtaaagcaggcagcacccaagtttagccagtacccaagtttagccagcacccaagtttagccagcacccaagtcgtcccagccttctcttgggagaaggagtagtcggagtctgagtctgactcggatgatgagtgaccgacagcgaggacttctataagagaaccattgcccagactctgtcaaaaaagcgaagactgctgtgaagcccgcttctaatgctgaggataagcctggttctataactgaggacaggcctgcttcaagtcttccactacagtgaagcctgaggccaacggttctgctaccaaaaagggaggcgaggctcccaagaagtctccttttttttcaacttccagtctctccagtctttggtcaagatgggtgttcctggggtgaaggacgggggaggactccgactccgatgataactccgactccgatgatgactccgacactgtcaattcaatcgagaggacccaaagaagcccctcagagttcgggagccactgcgaaccaataaatttgagccattaattccaattaaatgtcgatattttgaccattgacgcctctggatcgcttttccaccctcaagtacccactcggctccccaggcaaacatctgagactgcgtggccaagttggttaaggcgtacgactgttagaaacacgtgttcggaaatcgtaagatcgagagttcgaccctctccgcggtcgtctttttcctaccctacccccataaatggactcacattcatttttttttggcacaccccacacctcgcatatgccagttgcgatctgaactttggcgattgtgagtgactccaggagagaaatgggtgggtagaatgacctgaaaatttggctgccggtcaagattgccatcgaaatggtcctcacaaaatatctaagcgacaacatgtgaactgcatcttttattccgtaaaatgtccatctccccttaccaacaacccaaatgagaggaggttgagcagcgcacaaaaatacatccgagaaacgcgactgaagaagcggtaggatgcaaaaagtgatttctggcaggatcgaactgccgacgttctgcgtgttaagcagatgccatgaccaactagaccaagaaacccggttgtggactcggggtgggtagcgtggattgattgtgggaaacaccttaacgaattagaataaaaaagaagtaaataacctcaactaatatcccaactatacagatagataacaaagaaccaaaatagttccaagtctaaagctaactaaatatacttggggctaggtttagaatctagcagaaactgatcatttcaatcattatttacaactattgggttatgtgtggaaatatctatagtcaagactcatcatttataaccaattcgtccattctgcgtatcaagtcggcatccaacataccagactcacccaactgattagcatccaccacaagtctggtagtgatatcgtgaatgtacaatttttcgttcttaccttcaatgattgagtatctatagtctctcttatcaaggggatgggcttgatcgacgtgcacaacatgtttggatctcactttatctgttattgtctttgtatcgatgtccaacgagagttgaatagcacagtatcttttcggttcaaagtactggagtagtccatcgtagaatatcaagtgccatgggctttcactttctttcctactctgaagctctcgaaacctcttctggtgcaagtaattggccgtccagtatggatccgcaccaaaacaggagcttgcgaattcaaaaagaaacacgtgtggtcccataatctggaggaagaagcagtccacaccggcgtggtgcacaatatcaggttcaagtcctggggagtctttgaacttgacaatgactgttgcgttacctcccccaaagcaacaatacatttggcagtttccaagggtggtaatgatcagcatctggggaagcgatattatttcagacatgacttcgtccccaccttcttcttcttgttcttcccaatcccaccattcattctccttggacaaatccaccttgataccatggttgcttgtgtgaacacaagttcgcagttctttggcaggggtaacaagtggtgccgcatgcgttccgttctttggtgacagtctcattactgatccaaactcctcagggccagcccttctaagtctgggtgcaaacttggccccaggctgctgacgtcgtagatattccatagcacactctcggtaggagttgcgacaagagaactgtggttcaaaccatggacataatggctccaatttttgtttgaaaatagagtcaggaatggaaaagatttctgtttcggcgattgcgcagaggtcagccaaatctagaagattgcagatgagttccaccagttcagggggaagcatggatgacagagaggcacgacagcgtggctgccagagttgtggtgggtcggtggtgaaaaatatagagctgaggaagaggttttcatgcatcatgaggttctacagcctcttatatatacagtactgtatcccctacatctcccatccagtgtatgcattgtcgactcattttggatgcatgttgatgcgatcctgtgaactgtagttggttgatatctctatagatgtaatatttgcgtcttagttcaatttgtttgaaatgaatttcgcgtttttttcctgtttgttgtttttctgttttttgtttttctgtttttcgtttttctgttttttgtttttctgtttttgttttcttttattttttaatattattatatatatttttatttttgaatttacttgtagagaaatacaacacacaagctgttgaaggtaattcctcacataatgatgagaagccacgacaaagtgatgagaggaatcagctgggtcgtagacgagatgtccatcctgtagatagttctatccactgatctagaatctcttttctggtgaatgagcaagcacaaacccttctggtgtgtgctactcctagaagtgggttgtaagttgttaattaactatatctcatcaataatactagtgatcttcaatacaaacagtgtccaaaccacaaatcaaactcggattcgggttttcagaagggcgtatcgcaatagtttctgcggtttccccatattactcctacaccagatttttgccgtttgtttcttctttgctactatttttttatgatgtttctttttttatttttattttttgcaaaatatttcagtctttttaccctcttaaccgcccaacgcctcgttagctgcaacggcaagcctggttggctcagttggttagagcgttagtctcataatctgaagatcaccagttcgaccctggtaccgggcatccgtctctttttttgcccgccttttatttgttgtcatacagaatatctgcaatattgctccatcaaaacgttgtgaaactttggtcaatttttttttacttccgatctcaatgaaccctaaacatgaagaatatatcttcaactttgaaataagagagaaaaggtcggagcgagttgcatactcgtattcagcagttctgccgcgttctaatagtgttgcctaaattcttacaactattatattggtcgtaatattggtgtcttctttcgagcttcaatcttccaacctctcctccaacgatgtcctgtatggtatgtacagtgggtaagttccacacgcaaaaatggaaagtttttgtacgacacttgccttcatttattcaacatcacctatggaagtggtatgtccatgctgaatgcaaatttccttatcatctttcttgccccaataagctgatcccatcctaccatctccctaacaaaagtctaagtaatacctgttcatgcaaggaagatacttttcgtcttagtatgtacatactgtactcgtctcagaactctcaaacagcccagatcagctttcaattgctttgcagagaggtagcactacgattttcacacaatatctaattcatgctgtagtccagggcactcgttcgtagtaatgaccctaactagtggatggggttaggtatgtactggaaaagccatcaagaggcacgaaccagtcacactacagtacagtactgcatctatgcctataacctgctatgctggaacatgtgtaatgtctcttgtccatgtagatcaacgcatgcctgcaaatgcccaggcattgtagccaggaccatagtcatcgtagtaatagtctgaatagccatggttgtctgaatagtcatggtcgtctgaatagtcatggtcttcatcccaagcaccccaagggtcgacttcatcacctgtgccatagtcttggtaatcatcatcatcatcttcttctgaatcttctgagtccagatcttcagagtccatatcccaatagctcttagtatactcacggacagtattgtgagacaagaatctggcgagaaatttgccattttcatacccaagaaagactctgcttcgatcacgtccagggttatagtacgaatgtggagtttccacatctgtaataactccgctgtcaagatctaccattcgaatacctccatttttcgtccactcggtgagatactgcgaattttggggtctgagacactgatgaagtccatcgggtgctttgtcaggcaaggtgacgattttatcctgtctacaaaacacctttccgggctggtccaggtccaagaaggttggaatcagatacttgtcttgatgaaaccaccaaaccagtccattgtagttttcctcaggacacgacttgttcgatgcaaaagacggagtgccatacttgaccaatttcttggtgtaagggtcgtgtaagccataagtgcttcttgcgtatcgtgtcacatgaatatttccaacttgggagacagcgtcaatgtggggaggatagactgttgcatgcttgtaatgaggctggtctcgggggaacacgtagtggtgatgagtggtggggaccataattatctcactattaacaacaatgggagctcgttccaggaaaccagtattctttggaagatgttcaggacgaatgtgaccaggtagggtgatttcaatgtccataaagctgatgaccatcgcatccttactctcggaaaccaccttgatctggctgggctgctcgggcaccgcatcgagagtccagggactcaaaactgcacccagcgggaggttttccacgtgcaatctgtcgcatgagaacgagcagtcgaaatcccgatggtcatcgaacccctcgtagtcacagggcagcttctctccatggttgagccccaaagcagtaactcccttcaccggcttgggtggtggaatttcgacgctatcccagccgtctataactttccacttggagctggtgagtcgcgaaacgtacaccaacacacagtcgccccaggtcttcatttctccttctggcttgatccagggaaatcgcctcacaagttcaagcttcagatcacggtcagcatgtgtataggccaagtaccaataagagctggcttctctaagcgaaacacacgtttccagatcgcagtgggagtagatcaacgtggcgatttcataaggaagatacttcccatcgtccttagggctcactgcaacctcagactttggctctttcctgtccaaatgccttgaaaaattgacagcttccagccagacagaccgtttcaggctttcctcctgatcctcgagcagctcatgtatctgtgtctgcaatcgcaggccttctgccttgtcttgcaggtccagaggagggctagagagcatcttcgatgcccacgcatgcatgtttagtagagtccaaacatactcctcgacgaagacagggtgtccgagatgtggatctagcctctcaaacgctttggtgaccgtggatgtagtctgctggaagtttttcagcctcctgacagcctcctctctctccacgcgccatttctggttgaactcgtcgttctctcgaagcagcttctgtactgcggtgaaacattcttccctggaagctggaaccggtagtggtgctgtcgataattgagccgcgtgacccgacgccatctgtttcttcatcttcttcatgtcctcacagatcactttctgctcttccttcactttgagcagatgagaacataccaccagcagtttgtcagcctctgactcagttccattccaaggcgaaggcagtccttgtgttatggctgctgctgctgtcttaatagacgttcttgggtacattgtcagtacagtactgtagtgacacgttgtggtgaaaaaggctctgatgtagagaagccaaatccaccactactcaggtagaacattagttgaccattacttggtaccatcgaacacccctcagttcgaatcttacaaataccattttttataccataccttcgatatatacagattgagacggaatattcacgtggacctcgtcgttaccgaataaaaagcttcgggcgatcatatgtgacctctttagggaagacaggcggtccccgctaatcattttgtctcggtcttccccagtcgtcggacccactagcgttacatcaagaagggacccactagatgtaaatacgagagaagagagatctgagagaagaggtgtgtgaacaaccagcgaatcaaatattgaggaaacacacaacatctaaccacctgacactgctttgaaaaatcgagcaccaacggtccaaataggtattctcacggggtattattatcaatgaaagtctatgtgtctatattgtgttgtagaaagctggaagctgtcaagatgatggaactggactgcccaatctgggccttactactcattattgttttcaatggtgttggtggtagaaaagagcgagtgcggcagtatggtgactactgtacagcacctgtagtatgtagccttagtcactcgactgcacatgagacactcggagctctagactggttcccactacgcctctctcacctcctcaacaacctggctcttctccaactcctttctggcagccttttctcgctcttcgacataaaagtaccgagtgtacaccaaggaaatgtagttgaccaccgagttgagagcgatccagccaatgagaactcccacattgagtcctatttcggaatggacattgaacagaatggttctaatggcctccacagcattgaaaaccggcagagcgtggccaaactggtagactccaggtgacatctccagagggaacattcctggagcagagttgaaaatgacccagaaaagcagccaaattgcaagcgtagcggggaactttttggcgaagaatgccatgatgttgtcggtggctcctccaagagcagccatactcagaaagttgatcatccagtagaccacaaatccgcctcggccgtatcggagagtaaagtcctgtccaaacgccagagacacgagagagaagaagagtgagatgaagaagatggaaatcaagttgatcacggttcggtagatgaaaaactgccatagaatcatgtgctcgccctgaatgttgtgaatgaatccccacatcatcacctggtagaaggagatgatgacgagatagatgagacccacattgtcgatagcagacgccacaccgccggaaaagggtcgaatgtcgttgttttggaactccagaggcgaggtcagaagccgcggcgtgttggtgagcaagtctttgattttgtcgttggaaaagtcggctgtcaggtttcgaatgatctcaggaaccttctgctcctggaagagaaactcaagagcatcaacctgaggctgacagtaggtggcatgcacactttcctgtcgacctccagtgttgaagtaatgcagggttttgaaccagtagtcatcctggttgcccgactcaagggcagcccgtaacgtagcagtcgagttttcaaacaccacaaaggcgccccagaacttgtactgcaccactagctcctcaatctgctccagagatgtgtactcggatgacaccactggcttgatagtcaccagatggggcagattaggtcgctcgttgaccagatcaacgaaggcgtttccaaccacgtcgttgtcccagttgatgacggccatcttcagattgtgggctcgatctgaccgcttgtacatggatccccagaacagcggcagaattccggtcaacgcaatggccagagtgagcacgttgaagaaggacatcttggccaccatccagtggccctttcgaagcttggggtggtgcacaggcacataagttttcggtggaaggagtcgttcagacgaggttgtgctagacatggcggttgaagcggttgaaatgatcttttttccaccgcttgtcctccaccctcacctatatatcgtgtaaacaaagaccgttagtctagccactagtgcggaggagaagccgtatgtgataagagtagactggcagtataaacacatggttagatgtgttttttgggggaaatgaagcgatagtcgttggtattggggatcatggtatctcagagggctcctgtccgtcttcagtgatccccttcagctgtcatctccacctgatgacattctcttgctgcagaacggcgctaaaaacggcgctattttcggtgacataaatccgtcgtaacgtcgaggacgccgtacgagcgaggcgcagggttagtaatgattatcggtggcggttttggtcgcgtctttcggactgtgaaaagatcggctccatatcgaattccgctgccgacattttaattccggataggagtgggagaaaaattgccagtaagtataatgattactgttcataaaagtgaaaaaaaaaaaaagactagaaaaaagaccaaagaaaaaagaccagaaaaaaaaatatgagtaattacaatgagaataaacagaactggagagacaggaaattcacggaaaaaaaacatctattttattctattttattgtcagaaactgctgtcagaaaaacttccactctaatactgcgcaagtacgttcctgaagggaatttcactgcacccaccattataattccggatacagctggtgataattttagagaaatagcttctgcaatcaccgtacgaggtggaacaaagagaagcaataggtgacgaattactacatgggaagatataaataactcctaaaagtcgaagatcgatcataactgttcggtggaaagcaccttttcgacgcttccggttagtatgagttgtttacttgctttctagttagttggtgtttagttgacctttccaaccaatctcccagtcattactcaaacctccaactatcagccttctacattatttgaccaaacaacctcccaaaacaaactccacgttcatgtaccttacgcgtcagggatgcgcttctccaactacacttgacatctacatcgacgacattaattcgtcatagctccttctcaatgccaccaaaaaaacaacaacaggtcgttcccgacatgggcgacaccggtactctcaagcagcgcaaagaccgcaccaacagactctagacggcgttcagacaggaagaagcagacacagcagctcatttccagcagttcaacgagaagttcaagcgggaaattgcccctcatccccccgctccccgttcccgcatttaagcaatagtgtgcaactgctgtgaatcttctggtgcagaagcacgctacactgatgccccgatgacaacccaaaagacagcagtttcaacaaccgtggaaccagctgctggataaagctgccgccacagcaattacggtctatgtctttccgcgggacaagccctttcatttcaagaacgcgcttcaatacaggttcgatcgcagagagttgaagaatcgcgccaatattctttatttcggctcaaaaggtgagaagtaccagttcttcgacctccaacacaaagtgatacgcgatcatttcaccaccacggctcagcctgttgctgtctctgatggcctcacctggtggtgttcccttttgtggatctgcaacagccagggatcttcttctccagaagagacaagactgttatggtcgcaaatgtgagtggttacggagacctgaacaaccatttccgtcagtgtgaaaagccaggtctaggccgcttcctgttgaggaacttcatggagggagtgttagtgattgatcttgccagcaccactgctaccaatgtgtttactcctaaaaaggatcagaggaatcctgacatcgttatggggtttgtcgacgacaagtttgtggccaagttcgttgacagcaaaaccatgaagagatacgagcaggagaagctatggaagaccaagaccatagaaagtgaggggaataggtgccgcgattattatgatagcatgagggtgcatgttttctactcgcagaaaatatcctgtcagctggtatgaaaggcaggtggattggagatggaggtaatgcagttcttggtagtaaaatgctctcaacaaccatctcaattgcaccaaggaagatacggaaacaaaatccatatcacaggtattacacccaggtattatcactactatccaaatcaatggcctaactattccacttcccaactatctaactaaactcaactatttatttaccaaactaacataagcatcagaaaaaaaacacgcatcaagtacgctcataagcagccaaatgtgacaaaaaatccatataaaatatctctaaaacacccgcctagacaaattccaccatttgtaatcccatatctccactatatctctccatatcgcgacccctcccgttccacccgcctccaatgacttccgggtaacccaaccttaaaaaattactaccatgcataatcatcacagcatggctgaatcgaacataaaccccatacaaaaggacattttacagcacacaaaaacatgatccccggattcgttacacctggaattttaatatctctcgttgtcgaccgagacggcaacaagttttaccccggaatcggcacggctgttcgagttgtggaaggttccgaggccaaggttgctggcaagtcgcaggccaaggccattgtcgccacagctacgggaaaggtggtgctgagcgaacgacaggagagcgcggagcacaacgacaagtcacgtgataccaagggctcatgctacacggtcaacattgtgaagaagaccaagggtgacgattcatcttcaactacacctactacatcccatgtgtcgccctcggcttcgtcgggactgcccaaggttggcgattacattcttgcacgagtttcaaagctcacgtcgaaacaggccaacgtggagattctggtggtggagggccagggaggagtgggccaggacgcgggtttgggactcaatggcaacgagaacggtatccacagcaaccctctgtcaaatgcgggctctttggtggaaggcgctattcgatcagatctcggtgagggcttcggtggtatcattcggtccattgatgtgcgagccaccgagcgagacaaggtcaaaatggagctgtgtttcaagcccggtgatatcgtgcgagcacaggtcatttctctcggagatggtgccaactactacctttctacagccaagaacgagctcggagttctgttcgctcgatcgaaaatcggagagttgatgtacgctaccgactggcagaccatggcctgtcctgtgactggcctgacggaagagagaaagtgcgcttctccttataagcaggaggtcaaggctgaggtcaaagaggaggccaagtaggtatataggtattgcatgtggtgtatcgtatggtacaccttttttgatggaactggagatactaatctgtcagatacagtatatactgtaccattcaatttaatatatagaaggttcgtttctcatggttaagaatgataccactagccatgcttggggtttgtctttaggatccgtgtaaccagaccctctccgatacgcctcatggtacaacttgaagtactgtactgtacagtactcctttttgtcatatctgttgccaggacgcctcttatgccatcaaacttgcccttcttgtagtagatggacggcttctttccatgatgtctgattttgagctcgtgcttgatcagttccatatcggagtcttcattgttgtctgcgtcagtggaggaaacgtcgcagtcggaggaatatcgcctacaaatagaaccacaatccagttctgcaagtcctgctccttgttcttctggtagaccaactcaacgtcgcagtcaatgtttgtaaacttgtggggatcatcaacaaaacaactctgagaagcataggttcgtcgaggatacagggagtagaccctctttccttgcaagtcgaactcaacaaagggactagtgatccggttatattgagaggcgcagaaagcatggaataatatcgcctaatcagattgttagacccaacctcctgcaccctcgtgaggtgtgttagtcgagagctgatatatgtcgaaaacgagtagaccccacgtcatccccctcttgttgccaatataaagtagggaaagaccagttgacggtcggcctgtggttcttgcacagatgcttcacccgtcagcagatcaccaacgacaactccatgagctcctcgaaggtgacatctccgtccattgaagggtgacaaatcggtccattccctgattctggtcgccctggataattccaagaatcttgtagacatgggaagacgacaaaggtgccaagctgggggaaaagggcgctgatagcagtcagagctcgtgtgtcggttttctgtggaggcgtatcgtgtccaatcttctctcggatggtaggacgcattaggggcttcttttgttacagtaccccatgtctacccacagcctcaggaaacggccttcgtgaagatggtagagataaccattgtaggtggcgcaatattcttggtgaaatttgtctcctccatcatatccaccagcatccgcacatggagctgcacaaaaataatgtggcgcaagtcctcggtaggctcaatgtatcctaagtaaggggaaacattgtgtgctgcaaggaaccgtttgatctggaaacctgcacttccgggaagatggtttgggtagaccatgtcgtccaatgggatggtagtcggtcttctcgatgtctgcatgctcttcaggtccaggagcgtgtcgttgtggatcagtttgttccgtagagtccaattgagtcagggtgtcgataaatttcgtccggaaacacgggtttcatgttctctcgtaggtcgctgtcttcactctcatcggttgcatcgacgcggcgatagcaactcacattgcccagacaagacagttccagagatttgacgagtaagaagccatcccgttccccaatatcgggctgtttgatgagacttttctgtgtttgcgcgaccagcacgagtgcacactagttccaggacgtgagacctgcggatccctcgttcaacgcgaaccagtgtacagtactctcttgagcacattttctcgcaccaacgtcttgtccagtgatctccacagctttcggtacgactcccacgattcactgaacgccagtgtttccagctgctgagtttgaggatctccagcttgatttctgtagacaccgaatcgagagtaccagtcgtcaggttggcggtggtggagtcattgatgacagagagttcctgcatgacgttcagcgctgactggaactacgtgaacagctccaagtcgagtatgacatgtttgtggggtggcctgtagtacataaatcccctctacactttttttttcattttttttcattttttttcatttttttcataatttttttcatattggatccgaacctttttttaaaatagcggagcgataatggtatgagataactcaagagggtgtccggagcgatccaaaaaaaggcagtgagctttaaattaggacaataattgctgtgagaagctccccggtcaagagaaggagaaatttggtcgatatttgcaccaaaacacgtccgcatcactcgtacagtatagacgcgcctcgtgcatgacctgaaacaggaggagatgacaagtttcagggtctcgcagagatcgggaagagaattaatgagattttttgtacctttatgtgtactatatctgattggagatatgtttttgtttgtcatagtctcaataaagagcacatctcaagtgttatgttataggaaggcattttttcttttgcataatacatgtacattgattaattataacttctcttgcaagaatttttttctgcggtggagaccctgacccaacagtctaagtaaaacctggatggtaacgaagagaaatagcggaaaaaacgggaaaaacgtgtggaaataaggagaatataagttgaattggttatatttatggcgatcatctactttatcggcggagtacaaatatgttcgccattctaacaggtctggagtagtggcaccaagtcctggcattctctcctcttaactaaagttcaactaaataagcatcttatttcaaataaatacaagcacaattcaaaacgtgtgtagcagcggcaatttgcaaataaataccaagggaggtatagagcggtggcgcaaaaagttgtggatattggtaggcgattcttcggtctgcactggttggcagtttggaatcagcatcgttactgacggctatctttcaacgcatgatcttcaacgtatcgacgtcgttcaggggataagggaggctacagattgatttgggatcaatttgcaagtattccaataacacggtatataaaacatcagcagaataagctgattccagtcattatgatctcttgggccgatagcagtcattcttgaaaggagggtcggagagtggagggaggaggtctgtaaggctggtgggtcggagggaaaggtccttgaagtctgtcagtacaagattggtgctatatatgaacgaatgaactccatttgtcaccaactggggttgactagtcacttattaaaggctccatttaactgctcagtccagatactatcgtatgtactgtgcgatgccatactatacgagtactgtacaatacaagttccatatcaattattgatgacattagacacaccaattcttgttgagagcgacagaagccccaattgtttctacagttggcattatccacgaaaatattgaagccggtgccgagactgagcatggctgatggtcgagacgaaacctatgactgaccgtcgaggccaagtgaagtatttggggtttcactgacgggcaggtagtaggtgaaatactacaccacagtatcctacactactatacaatagctagttgtcactgctgacaccggcaacctgacaagataaaacaactgggaatcaggacggactcgagactgtggtaagaatgttctctgtacgcgcgaaagagacgtattgtaggcggacgagttgacagtctgctactgatagtccatctcaggttacttccgtaatcgcgagcgagccttcttacttgtagtcacccagggtcatattggcacattctctcaactacgataggcgtgtttttttctcggaaacatgaatttattttcaattcaaaacacttgtgccgtagggataagtcaacaatgctcctcagctcccccgcctcagtcctgggacactcggagtgaaagtcgtaccgggaacaagtccgagagtggtaacgcactcttgtcttgtcataactgacactcctttgaccggtatttgtaagaatttgccaaagttcattatgtgataattactttgatatcagtagaagacgcacatgtcgccttaaaatgtttcatgtactccggtcgatcttgggtctctttcgaacaggactgctgaaagggtccgattcacttgatccactgacacactggaacagctgtttagtcgaatcatgtggtggagacctagatccttgagctttgggcgtgcttgtcattataggctgtccactctgaggaggaacatttctcttagtaatggacctgcctgatacaagagggctggaaagatccacacggtcgggccgtggaccatggtatatgaagtctgtaaagctctccaaagagtcgtcttcatctgactctgaaccgatgtggacttgagacttaggtgtctgcggtgcctcactcggtacagacttgtcaaatttggcttccgtcactccagcaaatatggaatccagttcatcttcttcaggttcccacacgtcgatattctccaaggaagaaatggcatccagtgattgatcgggcgtagcaagataagaagtgggcagaggcttaggcgtgagtttctccttcaggtgtcttctttcaataggaatcagagtggaaatggtggaaatatctgtgatcttgacacgcatttttgtcttatctttctgatcccttgtgcgtgcctggcatttggcattggtgatttgaatgtaggaggtgtcttcatgtcgtagctgttgcttcagtctttcttcgactctaaacccctccaaactgactgtgcaatcaatggaatcggtcagatagaacagtccatcatcgcctaagttgagtttgccgttgatagtgaccaatctcgtagtatcaaatctgtcataagcctccttaagactcatcttagtactgacagcacgtggggtgggagttttcttcataggaactgctctaggatcgtccttccagtcgtcaatcagactaacgacgtatctgtggttatcacttcctcggctgaattcttcaattctccccgcttgtccgagaaaatgcttgccgtagacctgtttttgggcattgtagaacatgacgcccgactttgctcggttgaagtagagcattgagttccctttcttgtgtcccctcatctttttgaaccccctcaagaccaccacgttgccgactttgagaagtggactcggacgccattcgtcggagaagttgaccacgacctcggccgtcatacctgacagttgacgagacccgaagtcggtcaaggtgaagaacctaccatctcggatgacaagtacacgtgcaacaatgaggtcgatgaacgagtttgcccctactgtggaaatattcctcaccggagtgcaatctggaggtgacatggtgataggacgactttgaaagtttggaacgcgtcttgaagcgttctaatgagttcaagaatcagaaaaaaaagaggatgtttagcgcaagggagctagcgtgagatttccggtcgagaacagaaatcaaacccttcaataaacccgaatagttagacgtggtgcctcagagtgcaattaatggcgactgtcgcgtagttgtcgcgtggtggagagagtgcatgggagctgtgggctcgatgcagtaaaaatgaatgttgaaagtgaaatccggtagggtaatatctggccaattccttacataatcatcagagcctgctactgtaggtggtagacgacagacgacaaggctacactatagatagagtatctgctgatctagaattttttttctgagcaagcacacatcggaagagtgtgtgatatgcggagtccttcatttaaatttattttataataataaacaatatgaaactctataattgttgaataaaaaaatatggacttttatatagaaatacattaaagaccagacagagggatcaggaacacgggactacggttggatataggcgcaatgatgcacatgagatgactcctaagtttttcggattagtcaagacgagcggtgaaccagaatcttccaggttttcctggactagtcgcaaatcagcgctgcatgtgtctgatctcggcgaactgctctgaattcgacaagaacttggcaagagattcaaactgcttgtgtgacgttctccagagtgtgcggcgacgtctgttcgtcttggttgatagcttgagaggcagagtcgcggcttctctcgcttgagttgtatcgcgggggttggacaattgatgctgttcttgggtactgtggggctcttaagccgccaattgggcttcaattcgagttgtcgctgcacatcagtagatacaaatctacaggacagccatctcgtctacgaccagcaggcacctctcaagactatgaggtactctaccagatagcaccggtatcaccagcaacaagtcatagagtcaactatttgaagcaatttataccatccatacctggagatttacgtgcagtactttacagtacggtgaaaacttgattctttggcgccgattgcgctctgtcgacgtgcatgttcgtgagtgcaacaattgatgttgatgatatgtattgaggtcatttaaaataggtacaacggtgtgaacatagaagtggtgtattgtatgtacaatacttgttcgagtactatctccggttccataagacagacctgtgacgaatcgcatagacctaggtggccatggaccgctcaatttgcacacaacgatctggatgattcgcacactctattaaatgatagattattggtttttatggcgatattgagttccttctaacgggatttcttctaatggcccttctaacctcagggctcccgtagcctacagtacattcactgtagtttgaccatcttgtgttttgatgacatgtccgaggggtgatccgatgatcatgtttgtttgttcaccgtgcacccatctatgtcctcattaaacgtcgaaatcgagctcagcggactttcccgcagcgtagtcgaacagaacctggagagactcgagtctggattcgctggcggctctctggctggaaatgtggcgcttcagggatgcagcgatgacggacttttttctcagaagctgttggttattgtctcggagctcgctattgagcttttgcaaccgctggagctcgctagtcagcttctccccctcctgctcacgcatcttgagctcattgaacatggtgatgacacctgctttgaaagcaaggtcgtcggccgcatcacaaatcacagcagagaccggacggagacgcggattgccctcgcaggcctccctgagagccagaaacgggtccttcttggtgggtggagtgctggtgatcatcggagggttagctagatcaaggtttagttaagaagaagaagatttaccttttgttttgttagataaatatagagttactgagacaacgcttacgattacttagggtactggtgaagatgacggatgtgatactcggatatcgcgagagatttttggattcttacaacgagatatagaaccagacagacagattaaactagacgtatagtagtatactgaacttctagggcacaaccagcgtcaacaaagcaaaagcacggtctcctgtagcttggactcacagagggtactgtactgtatcttgtagttgaatggagcccgaggtttccagcttgatggggtcaagcttggtgggcttcttaaaaatcgtattggctgaaatatcgactatacttggtcctacttacagtcactcgtactgcacatactactcaacctaccctcgctaaaatacaatcaattgctatttacaggttcatttgtgatgcttgtgctggtggtgttcgtgctccttgtgctcgtgcttcttgtgatgctgctcggggtcgacgtgggcaatgtcctccttgaagcccttgtgctccttgatgtcctgggcgtccttggccagctcggcgtgcttatgttccttctcagtctggtggggggcggcgctcattttgtacttgtacttggtacctgtagatagaggaagcagatcaacggagtgtctcggcccttatatagtcttgcaacaccttcttgcaggcaccaaaacgaaacgttaccaggcgtacagtttgctggcgaccacgcgtgcggctcgataatgttgctcatcgcgactgcctaagcgaataaggcagcaggcagccgggcattcaggaacatttgtgacctgaaaacacgtggttttaggtaaaatgtttttaggaaacattttcaaaggctcagattcaccgatatttcttttttactccacccgaatcggtctcaaaccctcagatcgaagagtgtctccagtctgtatttccgagccgcacgccaccgaacatctgcacacggtgtatttcgtcgatacatggatctgcttagttggctggggtaggaggactgagggtagtcacatgtaatgggtcttttgagcagaattatctttatttgtgactgatgaggcgctgtcgtctcatgagagaccttggcgcgtcccagccacgtccagccggttctatactggttgttcatagcttggtaactgttctatgatagttaacctgagtacaatacagtacatcatgtatcgagtgaaactgagtacataatgtatcgtacagtacatatttatcgtatcgtacacaatctatcgtacagtatgtacactgtactggtggctacgacaaacttgaccaatgatattaccccgttgggcttacaataaaattgaattgatactcaggccggaatctgtcaacaagtctcctcttgtcatctgcagacttgagaacatctcacgttgactccgttttgcacgattggtaaggcgaaaagatacatggtacattcgtttaacgagcaaagaaaagatactaacagggaacaaatcatttggttattccatcaggttcgaaacgggtttccgactcaggttactgactcaggtttacggaagaacgtatgacaatcgtgctcgccgtttcttcctctagacccgataaacaataaatatcaacatctttgaatatgtcgctggtggtggtttcaaattggaccgtcgaaggctgcagattgacgaataggctgcaattggcttgaagtcgaggaatgggcggtcggggcgacaaagtgtcttggtgatgtcgcatgatattatttcttcctattccagctcgtataggtacaatatttgtcgaatcatgcaacagttcagacacacttttctttttcgtcgtaggttttctttcgtgagaccgtctctcggcgctcccgtcaaattctagccttgttgcacggaactccacaatgggcagccagtcttcccagtctcgctgtaaaaagtaaagtagcaagtctctggccagctccgtgttgactcgctccatctgtccatctgcttcagggtattttggtgccacacttaatctgtccaatctatgttgtaaactagcccaaatctcagctgtgaacaacttgtctcggtcagacacaatatccatcgacacaccgcgatatacaactcggtacaggtacaagttgcttagttccgctgcattcagtcctcctttgacagagatgacaagaaccatcttcgacatcctgtccacgacaaccccagacttgacagtggccattcaaggaggggatgatacggccgacaaagtccatcgtgatggctgacctgttcttcgtaggcacggaaagttgttgtaatagtccttgctgcggctgtcttcgaatatagataacttgacttaacgaacacgtcttgcagtgttttctcatcgtcgtcatcgtgtatgacaagtagaagtcatatctcttgagactttggtagttgccagcagtggagtgtgcctggttttttggtattctaatgactcattactgcttttttcagcaattttttttattctagtgattcattacagctatatacctagtaagccggattattggcgttcaataaatcatacacttctgaatcattgcggtatgcactgctaggcgctgtcagttggtttgtcgacgcttcgtctagttgatgtcattatcgtggtctcgtagtggtgaaactttttttttattattctaatgattcattacagctatatacctacttgtagtaagccgggttattggttgtttttttttgttttttttgtttttttaattctaatgattcattggctattttttttctagggactgggaatacacattgcgaatcacgaatttcacgaattggcattctggccgagtggtctaaggcgccaggttcaggtgactgaatcaatatcctggtctctccggaggcgagagttcgaatctctcggatgtcattttttaaacaacttgttcccatcgtcatcatcaataatgtggtaggttactttttgttatgactatcacccgatccttggcctttcacttctggttctcttgccaatcaactttcattgcctattagagaatgacattgcaaagggtcctactttagctacaggtcatcgtcgacacctatgtcgacaccaacgttcgccagcacgttcctgcaccagtagtactccgctgtcatagtcgctatcacttcttccagctttagtagaatggtcagagggcccaatatcccagcgttctcggcgtaatctgttaccccgagtagatcaaaataatctttctgggctgaggcaaagtcctctgtctgagcagcctcgaacgtgcggagtccctcaagttgatttaatagccggtttctttcaaattggatcagctccctcgaccagtactgcttctgggagttgagtgacttgatttctcgttgacgcacggccatcttctctctcagtccatcatggtcacattggagtagaagcgtagcaggagaatttctaggggtgctcgtgtatgttggatagagctggtaatctgcagtagctggtggtgctaacattggaatagattctataggcggcaagactggaggttcagactcggcttgcacctggccattgcaatttagctgtggtaatgtacgacttgaagctacaggttgaacctgtgatgtgggtagaggaaggtatggtagcactgggagatattggccagactccacttgcgggtgcgtagcatggattgattggccatgtgactgacattgttgcggtgtttgaagagctgctgcgtgaggatcctgtctagaccagggttgcaacccatagtcagtctgaaaagaagcgtggtagaaggactgatgtgggatgggtggggaagctggcatcgtgggtacggtatattgaggcgtaattgcagtcccccgagtggtagctgaggaacgaggagcgttgagcggtgtttttgcaactgtgctgtttgagaacgatccagtataggcactgttagagccgctggccttctcacttgactggttagatgtgccggcaatagtacttgaaggtacattgcgaagagcagctgggatgaatggttggtagtgcgtgggccgagttgtgcttgttggtcgtggtgacttgttccctactggtgcttctggggcaggaaagggctctaatgtaggggaatggttcaaccgtgtagggtgtttgggtcgtggatgtcggagcgttggttgctttggagcttgaagtggatttgggctctgggagttcgcggagatcggtcgtttcatatttcaagcactgggtaactagtgtttgttagctgaagagcccttggtaacgaaaatctgtgtgagtatcatggtgcggtatcattgaggagggggagctcacatctgttgtattggggtatctcaggtttgtgttcacaggtacgtaatttgcacaagaattgcagtcgcaatgcaaaggtcacgtttggttgacagtgttggaatgttgtgttgtaaattgaatggtgatactgttgtgcttgtgcttatacttacttgtacagagtatttataattaaaatattgtgtcaaatcacataacacaagtacgtacagtaacaccagactgttaatatatcattttatttataaatatattcatttcctcccattaatcgtcgagttttttttgttctagggaaatacatttccgttacttggccaacaacagggttttacccgcaaatcggattcgaattttttttatatattgttattacattttttattctagaattctattctaggattttttattctaatgattcgggattcttgaaccagatatcagcccaaaacactcttatactctcgtcagcttcatagtgccttcgtggccaagtggtaaggcgcagcactagtaatgctgagatcatcagttcaaatctggtcgaaggcatctatctcctcttctatgaaggagatgcatgcgatttttttggtttcctcaccccgccattgagctctgctacctggcttgatttagagagctcccttacacagttggacaattgccgcttccaaacagctagcagtggtttatatattcataccaacttttcaagcaagtacatacagtacactatgtacttacctgtttagagaacatgacaacggacttcaaatgagaatggtcctaactcaccgtttcgctactgttgagtaagacataaacaaattgttgagtaacatcaatttgagtgccataaacttgcaatgccagaaatttgaagtgccgtaaacttgccatattatggggccacttttaacagaaaatcaggccttttttgccaagcttacttcttcgggcataaactagggtcaagatgtatttccggtgttagcgtcgattatgcagggactaatgagataaaaacgttagtatgcactacgtcaaactcaaagtggacatcgtcaaaattggagctgaatggagtcgaattcgtggcattatataaaccatcttcatacgaaccccgcatgtaaaattctggtcattttggctatagcttacttacctgtgtgtataatatcaatcctcccctttttacagactccagaatcctcttctacatgttacccatgatcgccaagaatccgccaagtacgtgttttgtctcaaacactgaaaaagacaggttttgttttgtcgccgggtaagaaagagggggcttgggagagtagttatcctttcttccgttataccgtcatcactgggggactttttggcaccgttgtggcgcaaatcgggtgtttcttatgcaaatagtttgacacaacctcatgcaacaccatggaatatcatgaaagatctcggtatcgttacaacagctggtgacacttcaactccagtgaccatctgcctcactgccaactttttgacgactgatactcacaaccaagccttgtgacacaaacatacaaactccacaggtgtcttatgttgcccacaccctggtagtctttcaaccgagtttcagctgcgcgaagtgtactccccaattgtcagtgccacgtcttcttcaccataaccttcaacatactaactcagatgggcggcgtcctaggatctagttactaccatagacaataggcagggctagacagggacgggtgattctcaaagagctatgagccaaacgacagtgtcttcagagggtgtcggataggcacagtcaggccaaagtctccagggggggcatcttaatcccagagaggattttattttgtttagttggggggttgcgaaaaccaggcccaggttccaagcatagtatgagctcaggaacagagtctcataaggagtgccttggaaaactcgtgtctcctggcgattttcgtcttcaaacacgacgcaagaacccagttagtttcaaaccaacttgcaatcacccgtcgcgtcccaagaggggagtttgactacacagagacaaaaccagactagcgtaaggtaactcacgttctcggcggaacgggctcgtgagatttatttgtttcactagccgtccacgataattttgacactagtgatgttggagcaagggagatggtgctcttagaggtggaaggggggagttgaatcgtgaggaggcttgtttgcaagacagaaggtgtggggagtgtgaggagtgatgggtggtggatggtagatgagaagagttggaagggggtgatagaaggaaagtgaggggcggtggaaggttacgagcggtggaagacgaacggtggaagatgaggggtggtggaaggccctaggtcgttgaatacgagttattggagcgtgtgagggagaaattactggaacctttgggttgtttggtgttctcagtcacaacagtgtgcgagggaccaaacactggaaccctcgttctcaatcacatctgtgaacgagggagaaagcgctcgagccttcgggttgtgtgttcttaatcacattctccaggggcggtggagggaatgtttgaagagggataaggcattctagggagatgttggggttgtgtgagtgggacatataattaatgaatcacttttcttgaatcgaatgagttgtatgtgaataactaagacaggatccgaaacattgcattgtatggtataattgattttccagtctcggggatgttgtattgatgtgaagaattcatctaagaaccaatctgccttgggctatatcaacatctccaaaatggctctctactgtttatttccgaacacctactgcgtacaaaatacccctacaagatactttttccgcgtgaaaaacaagccatgacattcgcaaacatatatatttccatatcgcttattacatagacaactacaagtattacctgctccaactgtagccataaagggggcgaccccgtcgcttggcaacatagacaacatccagggcggtgacaatctgtcgacggtcgtgctcggtgtaggcaaccgcatctttaatgagattctcaagaaagattttcagcatggttcggctctcctggtacatctgggtggagattcgcttcacaccgccacggcgcgcaattcgtcggagagcaggcttagtaacaccctgaatgacatctttaataacctttcggtttcgctttgcgcctcctttcctagttcttttacctgctgtaccttgaaggcgtttgttgttcccggggttgagcttggccttggccttttgtcgtgtaagtgactcgagctccctcgtcaatcttatagagggtttgttcgcagtgttctggtcagtcgggatatcacgggcaagactagcttcggagccacgggggtcatcgacaacgtcagaaccaggtaaatcgggggtgggttgctcaagctcaaacgccgcattcaagcttccgttggcaccatgtacctgggggatggagttgttggggacgtcgctgccgttatttttgctgtcgtgggtggattcttttctgcggttttcctcgccaaagctgttgctggaggacccttcaggattgggcaccgactcctccgcccacacagatcggtccagagaagcaacttgtcgtttttcccaagtagtagcggggccttccgaaggaggggaatatgatgggtcaaactcagattcagaaatgtcgtcgctgctggaagctggagccttgcctttgtcccggttgggcttgttgttgtcgtcgtcgtcgctcgccagagctgctgtcagagggcccatcaggatcgggcgcagactccttgacaaacacaggtcggggctggtaatttggaaccgatcttcttggagattgggaaacgtcagaaccaacgtgagtagtctgattgaagggagcagaagggcgaggaacatcccgcgaagaagaagcaataggttcgtcggaaaagtcatcttcatacaaattcttgaaatcccttgggctaaccactggtgctgacacaggagagtcgtcaaatttatccgacgcgtccagaaacacatcatcgccgtcttggtccgggaatcctcctgattcttgcaagtcaggcataatctcctggtggtcgtcccagcctgttccagacctagtatggggtctctcatcgctgtcttcatcgtcgatggcaatttttcgacgttcacggggtcttccgaatgacccaggccgttttttatcagcttcttcagcttctgaagaagaaccagccgcgccctacggcgggcagagtgttcggctctaaccacagcttcacgttggacttgaaggtcggcttcatattcggctataaggtcggcatcgaagtcgggatcgaatacggcactaggatcttccagttttcgaaaaccctcatgtagggccgcgagtcgttgtttggagtggggaagtccgcgtgttggaggtcgcacttgatgctgcctctttcttctatcgtatcctcacatgggtgggtagaagccttgtcgggcgagactttgaaacatggctcgatttttcagcgtgtcgcgcattaagtgagtccctgggggatcacgccaaaagtctgccaccctgttctcttcttgcctgacaataattgggatcaagggagtttggcgacaccgctccgagcgtctccgggaagggttctgataatgggagttttcatcggcagactcttctctggtgaatgtgacgttactggtggacgaactggggtccatgctcctccttttataatctttttttccgtgtggttcacattggttttggcaacaatgtccagtacagttctggtgatggtgtggcagagttgactgcggctgtctcaatggggtatcatggaagaaaagacacaagtgtggggcaccttccccaatacatacaaatcaatcttttttgaaacaagcccaagttcaatgggctttccagccgattttcgattcgaactccgggtttttttttctgcatatacattcgggttattgtagtccagtatcgtacattatctacagatcaaggttcgttatcagagatactgagagtctaaaaaaaaaccccggctttgaaatttacctggctaatgatagtccctgaagagtctgaaacacctcccacaattgacatgtttccgagtgaacttgagatttaataacatgatgtgatacaccatgtttccacttcaacatcacattatcagtgatagatacagtagctactcactgttctataagaaatacagattcgatatccagtcgttgtgttgagagccaccaggttgttattgcaaggattctgccgataccaaattgctcagaaacgctcctcagtcgtgtcaatccaatagtcgatttcaacactggcgctaaaggaaatgagaccaaacctatgacgatatatagtgccgaatgtgtggagaacacgaaaaggttgcctgtatttgggtcgtcacctcccacaatcttgaaacacctctcacaattccgaaacaatcttcattgagatatctgcacccttttcgccccttgctaaacacattgtcattcatagtcagtcttagccttagatagctccccaggaaacgatctatttatacaatagtaaggtcctggtctaggggaacattttgacaccaaaaactcgtgtatttcgctgcataacatgcccacagttcagtttagtgcgtcctacagtacatactgtagctatgcatgttgagaaaaataaaaaattatataccacacattaacgacttatatatcatcgaattatatatcacttgggggaaggcgatccgataacctgactcttctatccatcggagagacccatcaggagagtctccgcgccctagtggagaattcgactgagcatgccaccagcttctacagcagatggcattctgatgtgattcagatgtgattcagatgtgactgatgtgactgacgtgactgacgggattgacgtgactgacgtgactgatgtgacaccgacgtgactgatgtgactgacgggactgacgggactcggaattgctttcattggtgtacatcctatcatttcacagaacaattctgtcttctttcgtttggttccaggaatatctatcggggagtgtgtgggataggtcggcagtgattaataacatattctgcacagtgactgaaatctacgggttcctatgactggatacattgagcgattccgttgtaacgtttgactgaacctcaatgtacagtacatactgttgctgaacatcataatgaactgacaaagtgaattgcgtgatggtatttgggctaacttgactactcattgtctcacctctaactgcacaaagtgtcaacggggcttcaatctcggcaagaacttcacttgcaagcccccaccgtctcctcaccagatctgtcggacttccatctcgatctgaggcccaagccagcgcacttatgggcaacctatcgcgattaccaaacgaggtctgcggttatttctatcaactccaacttctggtctatggacatctacagctttggttctccattcttccgggcgaactactccaatgagaacagcttggtcggaaggcgtagatcacggtccatattcaatgaaagtttcaaataatgtgtaaagggggtcaagagtggcttatcagcacttttttggacaggtcagttggtactcgctgcgttttctggttcctcttctgtatctgaacagtctagatgggctgactaacaacacgaccccatgaccgactgcagcactatagtgcaaaaacaccgtccacttgctaagtccatggactaatctgtgcggtaaaaagattacagcacccaggattctcgtatggtctcccactacaatactaactgggctctctggtgcttgactatggctgatcgaacgggaagccgtattttcaccaggatatggccgtaaccaaactgcgccgacccggaatcgaaccgggggcccatcgatggcaacgatggattttaccactaaaccatcggcgctttggaggtatttttggagctcaaatcagcttactaatgcatagaacttttttttcactcctacgaactttggaggctcaaaagtgaaccgtaccagacacaaatcaagcaaacaacgttcccaattgaacctgagaacgtgttaataagtctggtcttcttcttctgtgtttgaaatccctagtaagtacgaaaatttggtttttcgtgatgtctcagaaataccagtgccgaaaagcatgatttcgtcactaaacagatcgccattttgggctcattgttggagattgaaacagtggtgctgatctgaatggcggaggtgatgtctaataagcgaccgttcaaaacttgtatggattttcccgttggaagaccgtcaaatcgcaaaaatgtaataatatcccttttcagataggacatacaatcctgatcttgaattttcagccgcggatttagctcagttgggagagcgccagactgaagtaattctcagtcttgaaatctggaggtcctgtgttcgatccacagaattcgcagtttggtagatgatctacttttctttttgtccttcaagcaaatatgttctcttgccatagctgtgcattttttgaaggctcatggctcattggaaaattaggagaagttatgagtaccaggagccaagaggacaacagtttgctacagtataagacactgcagtcgtttctgggttggaaaggggttgtcatacaagtacaactgcagtactctcttgctgtacttgctctctcagagctgtttccgaatggctaaaatacacctgttaatccatccctccatacccttcgtacttgtacctccaccaattggttcaactattgtcaaggaaacattcaagctttaacaagccaaatctgcaagatctcctccagtacttgtcatgctcaaaacatgacaattgcaaggcctgaggcattgacaaagataccaattcaatttcaattcaggatttcgacgagccctccgaatctcgtttctctggaatgggatttgtgccaattgagatgcattgtgtctcaccgaagacactatctccatgttttgtctcaaaaaattgatacaacggtcggaattccaacggaaaagaccagccgagttgataacattgagattaattgctcaaatgtgctttgaatcccgaaatccctgcggaaacagcgttattggaaaagtttgggtgcccatgttcgccctcaaatacgcgattcggagccccggtcatcacaacagaggacgtggcgtaatggtagcgcattggatttcggttcttgtgaacgacgtcctccaaaggctgcgggttcgagtcctgtcgtcctctgccctctttttgcccctctttcggtcagattcagtctgcatgtctgatatctgtatattgatgcagttcaacacacaacttgagtagacgctcttcaagtatccacatggtcggtatcttttaatgtgcaacggtaataacttctctggtgcagtatgtaaggcagcatatcgtttctccacaacctgccttttcgccgctactctgaagacttgatctcctatctcacgctcgataccatgatctctgtccagaaaccctgcagttcaccgcccgtaaagatctcggtggaatagtcacttggagagagctttcaaacatttaacgctagtcctagccaagacctattaatcaatcgggcgtcgtagaagctattgtcaacagaccccgtgaacagcgtgaatgcagacatgaccaggccaagacaaaggaaacgtcgacactctgtaatatagctcataagagttctcatatgggatagagggggaaagaagctgcttctgtcataagtgcaccgcaccgatatctgtgctcttactgggttccgttctgtcatagacgaccattgggctggaacaggactggcgactggaagaatgtcagcagtgcacctctttgaccgttgaagacaaagctactgtaggtggaaatgtgatcaagtctagaatattgcaaaccgtgccattattatgacaaaggactcaatttcgctggttgtaaagctctcagctcttggagtaagagtcctgagatccagcaccttgtctcatccatggatttgaatgtaaaatgtcgtcgcaagaccatctgaaggagttcgtcatgctgcacttcaagagcgactagagaagtcggcgagtcccctcaatgctgtatttgcatctgttacagtgtttcaaacatcttgaatcgacgaggctgcgccgtctaggcaagatgttcttccactgctgcttagatgtatagattgatgttcaatcggagcttttcgagtccagacactggaaggtctattcggtaaatctccaccgagaggcctacggactccagtcttgcggtatcgcgttcgccgtgtggaaacatgtattctcccagcgatgggtaaaaagaacagttcattttctagaacattgtctggtaacttgtccatggcgtgttctggagagatgtgaatatatggcagggggttctgtccgtgcactcagcttgttcttgtttgttattgttctacttgtaaattagttgagagttagaatgcaagaaagatatgcaagtaattttacttgggaacaaccccgtgaaggtgtccaaatgtccataattcgtggcgaatcgggagtatatgttttagtttctcttctttcaagtctgacactcgtaggctattcaaatactttgacttttcctcacctcctcgccatcgtctctccactacctcgtcgtcttcgtccgctccaccccaactaaacgtcaactaaaatttcctataaaatgcgccctcaaaagacaggcagaaaaaaaatggtaaagagagtcagaattgacgaaactagtaactaacagatcctcaagactttaatgaccatatcccttctatatcttctgcaaaatccactcgaaaccacctcgcgccagacttatattgctcgctctggagagtttggtacctacagtactgcgcattataagcgctcaaccaacgccctctgataaagctggacgctgatccctacagcgaagacacactacttgtacgatagtgagaagacacgccaggcagctgagtacccttacaccacccatttgatgaccacttcaccgcctttactcaccctcacgccatgtctgaacttaacaagttgattctgaaagcagtcacgtcgagctcgctccaggaccgcggcacgttctactttctgttcagccacgtggacgccggacgaagaagcagatacacaatcacatttgtggacgcggacggcaagatgtctgcttcgccgtcgtttggcctggttgtcaacgactggctcaaaaacgccatcgctatcgacatggacacagttctcattgtgcctcatgacggagctccattcacacttgtgaccaccaacaagtggaagtcgatcacaattccgtcagctgacccgaaggaggtgctccgatcggtcattgacggcctgctggaacacaaccctgccagtcagacaaccctgacccgagtcagagagactaaccagggccacgactttgtcatcgcctgcgaggacggcgatattccagttcattccatcattctgaaagcatcatggccattctttgacagactgctcgacagcaaaatgcaggaagccaccgacaaacgactgactctaccctacccaaaggaatggatcgagcctctggtgtctcatttctacggtgaacagagaaacatgtcgtttgaagaagccacaggcgtcattatcaccgctgcagtctacgatctccctgctttacactccctagccttgcgacgtattagagaagagaccatggacgtgctgatggcagtcgtggcatggaaacgggcctacgaggcaatgaaccaggccctcatggagtactgtggagctgtgatccagactgaaatgaaaaacttcccaaaagtccaacacctgctacaggacttttctcaggatgagttcttgcagctcttcagccacatgtcgctccatgctcaaaaggcgacctcaaagacaccgtgcccctctggatacaaccactggtattattaggaaaatgtacagtaggtagtgtaacttcgctttatacattcctaacattaattatacatatatacctatatctgagctatgtgattcaacgcccttctgcgtgtatcgtgattttccttctccttgattctgtttattttgttcccatgcaataaattagatgtgttaactgtcccaacccagaaggggacgactagattccaatgacggacaactccagggtccacacccggcggatgtggacggtgatgggctcatcgtagcccgggataccctccagcttgaccgagtcccaccagcattttcgtgcaggtttgcgccagaaaagcagcagtttgtgacgcgtcgactcaaagtcgtcctccccattaggcccggagttgtcttcctcggcagtgtgcatttccgtatccgagggaacacctgtagcagcctctgcggcagaagcggattctgcggtgacgggggccccactggaccgcagctggacaagcgctaaacttccaatcacagcccgaccgggctcggtagatcggtagccccaggtgtcgttcagagtaaacccggagttgcacaacatctccactagatgctgctcggcagtgccgctctcactaccacgcttgaggcccgaaaagatgtggtctcgctgcacaagctgggcaccacaggcgaccttgagctcacgcatctcggcctcggttgtatcacgcgagggcggcagacagaagtagtccaggtcctcacgtagtaccacgattgcgggcttggtgcgtagcatctccacggacgcgccatcttcgagagatgggctccactgttgggcagcggcctcggtggggtctactctggacaagtagtcggcctcggcggaccggaacaggtcaagcgtgtatttgagacagtcgggcgagaagttgatagcgaccacgtcctgctctgacagcgtctggatgacgttgccatggatgtccatgaacacgccgttggggaacaacgacagcagaatggactcaggcagcttcatgagctcgtttcgagtcatgtcgaacattgtgcctcgagcgtacagcttgatagcaatgtcgggctgaggagccatatcgtagcccgcctggttggggtacggttgctgaatcccggcttcaggagccacctgggtcagcacagaagaagcctgtacagacattgaataaaagtttgtgacgggcggagaatagggcggcgggggcggtgaaggaggagatgcgctcttcttctttacaactaggtcgacgtcgttgttgagggggtcttcgctatgtgtgttggtgaccgagtctggggcaacagcgctcttagtgtcgtaatccgagtaatctggaacgggtccgaaatccgttttcgaagtgacaaaagtggcggtggaggctcgcgaagaaacaggttcaagcggacacagatcgtctaaaggagcgactaaagttggaattgaagagacggtgtattgctcctgaatgatggggtggttgagtgagaacgaacgagtggcgtgacgtggcgcttatatgtgaaggcacaaacccgaaaatgtagtcgaaggtcgattttgtgtactcaaaagcgcggtgtcgttaacacgattctgccaggctgtcaggggtgggtgcagatgttagtccaaaaagtgacgatattattattaaggtgcaatcgtacagtgtgggaggtgtagggtgtagggactttagggttagggttgcatatttagcaacaacattgggcgttttaagttgtcaaacattagggttgttaaatatttagtttgggggaaccaaaactttaaaaaaacaaaacatgtgaattactaagccaacgaggaaacccgcggctaccaccaaaaagattaccagggcaggagtactgcagacaaaaaggaaaggtcgtacccggaatcgaaccggggttactggaaatcgactattaatcagaatccaaggtgataaccgctacactatacaaccgctgtttttgtcgaatgtcatctggctgaatttatggggcaaaatattgttttaatcgcggtttttttcatgaaatatcgtgatttgaggagccttgggagtggtatggccttggtgttatcattatttatatactgttattgttttaggagcatctcaagttgtgtttagttcagaatgttttggtggtggtaatggtgcagtatgcatcgtatgaacagacgtgtttgacatttattgagcaccgatcagttgaaaagtacaagtacaagtataaatttacgcctttctatctggttcgtacaaaagcggtcgttttcttttcttgccttgtcacatctctactcgtacagtacgtgttgaatgattcgaccctgtggagcttgccagtatgtaaatttcgctatatattccttctcttaggtgaaatgaactcttaaaatccaaccagtgcctttctcagaagcaccaaaagactccccttgtgtccccagaacttcttgagcgacttgcctccaccgctgtaggccaggagattgggtgtttcttgtccgacgtcagtgaggattccttcggtcgaaaacgcgaggaggttcttcttgagctgagcgggtgtgacagaggtggcgaaggctgagtcggaatcgggctggagagacagaaagtaggtcaacaggccagcaatgtgaggagaggccatggaggtgccggagagcgtggcgacggcgttcttggacccaatgtaggtcgacagaatgttgagaccgggtccaaagacgtccacgcacttacccttgttggaaaagtaggctctggagtctgacagagtcgaagctccaacggtaatggcgttctctgagctggcaggagagtactcgcaggcatcagagttgtcgtttccagcagctactgcaaagttgatacctgccttgactgcactgtcgacagcgagattgagagaaggagagaaaccgcctccaagagacatgttggcagtggaccccttccatcccttgggcggcttcttggtcttctcctcgtgctctctagcagcgtagacaactcccccaatcacgtcagacatggttccagacccgtccgaacgaagcaccttgacagccacaatctcggcctgcttggcaatgccatacttggttcctccaattgtgcctgcacaatgggttccgtgaccgtttgcgtcttcgtcaacgtctccggagggaacagtggttccccatttggcccgaccatcaaagtcctggtgcctgacaaacaccccagtgtcaataacgtaggcagtgactcccttgccggcggtatcgtcataaacgtacttgttgaaggtacccagattgagccggtctctgtgggacactctagctagtccccagggagcgtccagttcttccttgtactcgtacgcatgcacaatcgagtccctctctacgatagacactagtggacttgctctgatgagatcaaccacggtctgcgaaaacactccggcgtatgctttgaacgagttgatgctgaatgtttgtgtgactccggcgagctccatatcgcagcttccaagcattttcttcagccagtttagatgattttcaaactcctcctcgttcacgtctttcagagtaataatgtaggcattgggcacgtgatctcggtcgttttcgaacagaggagcgagagaaggcggagaatgctcatacttggccgagtgctcgtttccaggtcggtttgcttgcaaatcgttcactagtagctggtcaaactgcactgcctctgagttggccgggactgccgccagagccgatgaaatgagggtcgtcactaacagggagagtttcatggcaggttgatgaaggagagtgtgcttttcctgggcgcttcggcctgtataaagagtgtacacggggcgtgcaacaagtcatgattgctcttcggaaacggaaagtgtattcccaaacgggaattttggatatcctacaacagggcgaaaaaaggaggaaaagtgcatggaaacacgaaaaatcagatccagtcggcggtgagaattgattgcacctgaaagatttcctgtggccccaaaactggtcgtattcagccttgcgcggaccaacatggataatgctactcatgcatatcaaaaggcggatgcagatcagtgtagagaaacgtgggcctttggggacttgaccaggttgcaggtatatttacgccgttcttgagtccgggcgagcagtcgggatagttcatttttgcggtttattgacccctggaacgtgtccaaatctcgtatatctgtccgaccccaaaacgcgcatgtcccaaaacagacacggcttccaaattgggactaatgaactttcaaggcagtgtttcacgttgcgtcataaatggtgggtaaatgatgggcgggatgagagatgggatcagtcattttgatcaaggcggtagcaagacttgctcctgttttttattgtcattggagtagccgttctacaaggtattcgtgcttgtaaaagtacagtggttcccacgcgtactatgttcggtgtgctagtcgaggttcacaacgagagactcatggcttggagaaggagcaaattctgaggcacaagtacttgtactcgtaaaagacaaccagtttgggtcacgtgaatagcagctcgaatagatgccttcagctcgacattcccagccctctttggtcggcatgattgagctggctaaatccactgtgtatggcaagagttgagaggtccagaatgaagagaaagaaaacgcacaagtcgacgcacaagtcgacgcacaagtcgacgcacaagtcgacgcacaagtcgacgcacaagtcgacgcacaagtcgacgcacaagtcgacagcattctgaattcattcaatgttagagattgcacgctgaatcgtactgtactgtacttgtacaagtactagtaggcaatttcgcttctccttcctgcttgtctccatcggtgtgcagtatgtactgataagagctttctcaaacagctgttggaagcccgtgaggctgacgcggcttctccttctctttcaggaatgtgtgagccaggtcatgttgagtccttcaaacacggcagttgtcctcctatcccctgagattttctggagcgggaaagccttcgggtcatacaactgacagtctggcagctgtttgatcatcagagcgatcctaacaactaaagttgtggtagtttagtacttgtgttgtacttgcacttgtacttgcacttgtactggtacttcgctagcatcaatctgcccagaggcacagtcttgtgctctactgtgctctgccctactcgtagttttcatgagactacagtattgcctatctcctccgtccatgtgaccgctccctcattccagtatataaacaaaagtctgtccaccttctactctaccacacaaaatgaaagataccaagcccgtgaacaacgaaaattacgacccgaacggcgatgaatcgaaccacaacgataccccaacgattcgtcaccgaaaaaccccgctcaaggaagacagctggcccctctcaggatccgcccaaggaagacagaagcccactgctctcaaggcttccaaaccgccttcaagtacagacagaaagataccctcccctaccgacgaagagatcgccgaggcctgggctgctcatccgggcattccccccgccgaagtcagtatcaagatcatgcaatacgacgattcggagccatctgaaatctgcgaggaagacttttctctggattcacagtggctgtctatggagattgatcgaatcatgagagagcagaccgatgatgacattcccacttgtagctttcagaaaaacacaaacttgggtgatgcctattctgccgataccagtctgttgttctgactccagtcgtggccttgagatggacatgtccaacatcagcaaagagcttgccagactcaagacagaggagaacagggacaaggagaaaaagtcattcagcagtgagggctctttggaactgagtctcttgacatccttgtgtacttccaccccatacaagactagaccctagaggacagtcaggaattgggcatgagcatgaggaatgagatggctatataatggagataataaggatacttagcttgttgaagcatgtagaacgtgacaaatattggagcagtggtaataggaatggagagccatctttcacgatatggtctagagaggtagagcgtctccagaactcctataaccacttggaatgaagaaattgaatggtaaaaagaacgaaaacgccataactggacatttgaagacctccccaaacggtttgacacaaaatctcccggactaaggcctttttgagagtcacagaaacccccaccatcatcaacgtgatatcaaacaaggtttgtgcagttaccatggaaacggcaattaatatgtggagggagtgtaggagggaggtgatctcaattccaggatatggactcaatttgatgagggaaaaacggaaatacaataatttaagttggaaaaaccatgatatccactcatttttcgccttattacaattaaatggcgatttacagacgtccccacaaccactcctccatctccaacaactcgtctgcatgaaaccttaaccgtaaacaattttttgacaagattattttgcataggccagaagccttactacaccacacaacacccacaaaaatggccaccttgctgcctcctccctcgaaaaaacaaaagcgactcgcacaggagcccaaggatctagatctgatccccgaggacctgcccaatgtgctggttcgattccaggcgtcggacactggcgaaaacactggtggatcggtgcgagttcctggagccgccaccgaaaagcagctggagatgcttctgaaccagctccaggagaccaacgatgaccccacgccttacactttctctgtgatcaagggagaaggcgacgaacagacgctgattgacattaccgacaacatttgggcatcgattctcaaacccggacacaagagtacagaagaccagctgacgattgtgtacaccccacgtgctgttttcaaagtcaagaacatcacccgatcgaccgccgccattcctggtcacggcagcactattctgaccacccagtttgcaccccacacttcgtctcgaatggtttcgggctcaggcgacttcactgcacgaatctgggactgcgacactcagacccccatgcacactctcaagggccactctaactgggttttgtgcgtggcctggtctcccgatggtaagatgatcgctactggatccatggataacaccatttgcatctgggacgctgtaaagggcacccagattggaaagcccctcaagggacacaccaagtggatcacaggcatgtcgtgggagcctctgcacaaggtgaaggagggtcacgtgccccgactggcctcgtcatcaaaggatggcactgtacgaatctgggacattggagccggcacctacctgcgaaccatggccggtcatagaagcgccgtcacctgcgtcaagtggggaggaatcggtttcctctattctgcttctcatgacaagaccgtgaaggtgtgggatcccgaatctggccgtctccagcacaacctgacggcccatggtcactgggtcaaccacattgcgctgtcgaccgactacgcccttcgaaccggaggctttgaccacgacaccacacgaaaagacttcaaggccagcgacactgagctgcgaaccaaggcgctcgagaagttcaacaaactggccaacacctctggacgcatctccgagcgaatggtgaccgcctccgacgacttcaccatgttcctgtgggagcccgaaaagagcacaaagcctctttgccgaatgaccggccatcagaaggccgttaaccacgtcacattttctcctgacggccgatatctggcttctgcctcgttcgataactccatcaagctgtgggacggaagagacggcaagtttgtcaccacgtttagaggacatgtggcctccgtgtaccagtgcgcctggtcgtccgactgcagactcatggtctcgtgctctaaggacaccactctcaaggtgtgggatgtgcgaactaagaagttgttgtcggatctgcctggccacgctgacgaggtgtttgctgtcgactggtccgtcgacggaaacaaggtggcttctggtggaaaggacaagatgattagattgtggtctcattgatctatatttatatgcattgtaatagacggtagaatggtttcgtacacatccatgtgaagtggacatgggtggtagagagcgtgatgaagagcagtatcgagggctgtaagggaagagtagacgacctgaagatactgcaaaggtgtctcaggaagatatggatccaggctagcttgaacaccagcagtaggaatggaagaatggaagaatggaagaatgggagaatgggagaatgacattatcatactgaatgggcctgcttcctagttgagtaggaataatcaaacagaaaaaagactttagctggatggtctcaatgatactgcgtacagtagtttttctctcttcagcctggtaggtcatccatatccatcatcccccttttctcttgtttggtcgcacgcccaaatcgaactcacgaccgccaaatcaccatcccccaaagtctaaatggtgatgtgaaattttcagttttgagggagagatcaggacacaacctccaacacaacccgctgaaacatgttccgaacgacatcagcccgaatcgaggccgcgtgtcggccgctggcacagacacagatgcgatttaagtcgcaactgcaccggctcaagcacccccagcacattgcccagctggtccagaagcgaaagatcaccgctcttgatcccttctccaagcaggttctggagcgaaacaaggatgcagttgccaatgcgttccccgacgccgcttctttcgacgtggctgctctcgcgccccagcgtctggctctaaagtccgagggaggagccgccgtggctcccaagaccaacaagtccggctacggctttggtaccgacggatggtaccacgttggccgaaccgctctcaaccacattgccgtccactcgtggaagaactccaccaaggtcaagacggagatctccaagatcaccggaagcgccgtgcttctgaaacgagacctgtgcaaggctctcgacctgcacaagtcggacgtggttatcgcacccagcggtcgaaagatctacgttcgaggcaacatggtccccgaggttcgaacctggctcgaggccaagttctagcatgtacatattatctaaaattgttttattggactgaggagagagatgaaggtgtagcgtgagaaacggttggacaagcacaagtggaagtgtcagtgttgttatcatcagtgtgcacacaactatacttatcacgagggtgtacagtagttggggtttcatccatctgagcaatagattgagagggatattcacctgtcagctactgtacatactgtacaagtacaagttgacagacgactgaccataatcagtatccaaggttgagtatgtgaacgaaacgccgttatgtacttgtacttgctgataccatgatagtcattttatgattatttacagagttacctgttcaaaaaccaattaggaatgttttcaaatagattcttagcagtgacaccttgccttgcaagccgatctgcctgcttgtttccttcactagaaccatgggcctctacctttttcaaaccaatgcaattggtgctttcagccttcaatgtcaggatacgcttgatcacgtcctggttagccactggttccccgccccggttccgccagccgtttcgttcccacgcaatgtgccacttggtgagacagtcgatggcatagcttgagtcggtgtaaatctcgtaaagtcggccatctgagagcttagatgcgcaaatgcaatacgcgtgaagaattgccgttagctcagctctctggttggtctgaggcgacccataaacacgcccggagaggttttccttatggttctctccgagatagagtccaaacccagcaacagcgtctttctgtccgttcctagagcacgcgccgtcagtgaaaatctgattgataatgtctccatctgagttggaatagtgtagacctcgttgttctggaggaaagacgagagcatagtcagtttcttcttccacatacccaatagcttcttcgaggctcagaaatgactcaatgggtagaaatttctgagcagcacttctcatggcctctcgttcctggtcgaagatgaggttttcgcaaacaaagaacatctggccgccgtttttctgggaattagcagcctggatcttcttctgggccacccgtaagtccagctctgcctcttgcaactggttctgggccgcttccaagtctctctgggccgcttccaagtctctctgggtcacttccaagttcttcaaggcggcttccaaggcgtcagttttcacagcgacattgattttgaacaggtggatatcagccgtggtgtcctgtacaagttgaactagcatccgagtcgaaagtccagcatcgcctatccaggacatgtactcctgcgccttgtcgtagtcatcgaagcccttccattctgcccctggaaacctttccgtctgtttgtcgcactcagcaaaggagttgtaaatgccgggcttgcgtccagctttcacagcatagtactttttggccattgcgagagagcgtgtgtgatacggtgcgcaaatgttgtcttgcgaatctcgtcccgttactgtcgccggtcacccagtgtttctctaggcgcccaccgtcagtaaaatttcacaccgcaaaataaattcgtgaagcttgaaacatgcagtgtgcgcgaaactccaacatgacttaatctcttcatcacaactcttccacaagtggtgagaagatacctaggtgacgacttctgctctacaagtagatgacgaaggttcattctgttgcttcagatcaacttcgccatgagactgtgcaactacttgtagcgaggtttgcagcaactgaagatgttctcatctagcatcttgctggggaccccgatggccatctgatacgatcgtttcttcgacaatgacactgggagaagtcttctaactgtcccttgtttcaactcagatctgaaatgacgttgtctcaacactgtgccaaaacagccatctcagcaaaacagctccctttcctcacactggccaagtttttttttgaaaataatggtgctgggattccgtgttaatacccagacactactcataccatctacactgtgacaccagaacaaccgatgaacctcaaccatcactacatcgacaaaacttctaccaaattctaccataacacggcgagatacatccagatacgccctatacaggcagatattaccccagaatagcaaaacaagtcttttctgagctataaaattgtactgataatgtctcttctgactagccttccgaagagtgccgcttgattaacaaccgccgcagttggggtcgccacacttggagcaatgcttcttctcctgagtaggagtaggagcacaaggcttggcatcaattgccacagtgccggtgatggtggtgtagtgggtggtgatgatggtggtggacttggggcactccttctggggacacttcttggagtggatcttgtccttgaactggtggatgtcctggggggactcagactggtcgttgttcacgggaaccgcaacggcgagagcggccatggacaggagggcgaggttcttgatctgcattctagtagattggttgttggctggttgatactaattgaggggtgtcacactggtatatatactgcagaaagatcttgaacttgtccaaacagtagttgaacttgaccaaagaaaagttcaacttgtcattctcgaggctcagttgtcattcgcgaggctcacctctgctcccgttggcctattacttctcagtctgccactcccgaaccatcataaactaaccccatagaccatctcggaaaaccaacccctttccggcatccaccaatggtaaatatcccgctgcagttgccgtccgggtgtgattgtatgctatgtcagagacggaacgacgcgatgagaactatagggccatttcggaaggttgcggtgaaacatgtgacaggcagatgagtaggtggaggaattgcgtatgagtagagctatgagatgaacatgtttggtatatgctgcaaagaacttgtagggtaagaagtgacgaacaaaagcgcaagacaagtccggtagggatgttggattcaggacaatatctcagaaatgcatggattgagagaatcgtctagactcagattaatacccctcacatcttttgggtcgaaaacagtgcgatctccaactaccaggcttgaattggtgatgaacgtgtacgtccgatgcccactctagaaacatattgggctgtttctctgtgagtgcttcgaagccagactgcttctgtaggctctcggctctgacattgtagacatggcaggcgtaagcaatggcataacctcagtaccgatcatcaaagatatagccagagtgctagtgttgcaatgaccaactctaggccgaagtcacaaaactatagatgctgaaggcttcctaaaagtacgagtatagcgagatgcaacaataggtataaacaccatcttgtttctggggtctctatgtatccttgttcctcgtagctcctacaaatgaggaacattatcatattaagcaaaaatcaggtatacaaaaccaccatttaaattcagaaaaatcgcctggctagctcaatcggtagagcgtgagactcttactctcaagcaatctcaaggctgtgggttcaagccccacgtcgggcttttttgccattcatctcgttgatacatgtcgcccatatggcaactttttaggtctccttttgggtgtacacttgtttgggtctaacttggctaagtttaggacaatgggtgcccctgaaaccatgcccctgacttgtgtggaatgtgcaatataataatgtgccaagcccgaggctgcgtagaacgatcttgtctggacaacgaatcagagccctggcaggcgcccaaccttgtcgctttgcagggtgcatttcgtgcgcatttttgggcgcattttggcattttggcattttggcatttggcgtgtggggacttgtacaagggtaaaaagcaaagggaatacgacttattatagccagggtgaaggagttatgtatgagtgtcgtaccagtgttacagggtgagacgagacgagtgagacgactacaagtagcaagggtgacgtataatatggactatggacggttcgtaaagggcgtctcggttcgtgaaattcagagacgttcgtgaagagcgttcattccacctcacgatgtatactccgtgggtctggagaaagaggtcgactacagaagatcgacattgtacataaaatgtttggccacaagccgcgatcggcaggtggggtgggggcaagagtcacgtgtagacagggaccgtcgtcgtacttgtaccggaaccgaagcgttcacatatgggctgcaaagtacttgtcttgtggacgtgttggcgttggagttgactttatgatatatcataatatatgtccaaatttcagacgcgccgtttagttcatctcaagagcaccatgtgcagcgtgcagcgttttcaactttgggcggcacccatgtcatgatacgaaggatacggcgtttgggcggttgcggctggatctttggagttcattctctcgcgatctaccaggcacagaggaggatcgctgtggtttgtgtctgcacattccgggtttgtttaggttgagctgcgagtatgttggacaccattgggaaggtgtctttccacgctgggtgggagactgtcgatcgtcgcaggaaatgtcaaaagggtgggtgggcatagcaaaatctgaagtggccgcaagtacaaacacagcaggtgagcacagcgagtgagcagcagtgagcagcagtgagcagcagtgagcagcagtgagcagcgagtgaacacaagttttgtccagtgcaaggtagtatatgggctaggacgagtcaaccaagggtaatacaagtacgaggatggtaagagtacgatatgtacgagtagcagtacatacaattaataactggcatgtacgtgcggtgcttgatctcgtgtaatggccgggatggccaggtctagacgcaggtctacgctacgtcgtacgtaaagtacctgtacggtcgtctgatggtttattttatttaatttttcaattttttcaattttttcaatttgttcaattttttcaattttttcaatttgttcgatttttttaatttgttcaatttttttaatttgttcaattttttgttttgtctacgaaaaaagtacggtacagtcgaactcgttcagcaaacatgtctcatcccttttctccaacggctccaaatgagacagtcagcgagggtctattgcgagtacttggagacatacgatcgcactcactctcgcactcgcactcactctcgcactcgcactcactctcgcactcgcactcactcacaactctggcgaaaaagaagacacacgacagctgcgactgctgctgtacgggtccatacgcccaggggaaaatgcagaaatacgacctcttttaccgacagacaaagcccaataaagaacaaacaagccggagaagtgttcatttacgggaatggaggtgcagcaggagagagggagatggagacggggatggagacgggatggaggcggagatggaggcggagatggaggcggagatgagggacggagatgtgggacggagacgggagacgggagatgtgggacggagacgggagacgggagacgggagactgactgagctgagctgagctgagctgagctgaaaccaaccgttttttatataacaacgaccgacctatttaccgctcccctctcgctctccaccacaatgccccttttagagcttgcatggttgagttttcgggttcctagaacgttgaggtacaaggcgggtttaggttgttaattagttatttacgtcatcgccctcggcttggattgtagcggccacagccaacgcgaggggcacctgtcacgagaaagcagccatctcacactggttccgacacgtcgaccgctctccactgtacgaatctccctttccacgcgattggtggctcgcaaaagacgtgctcgtaccaataacaaccgtatcctacaccgtaccaggcgcgctctctgcacctccgtaaattacgtttctgcggttgtgcaaacttgcctcttcatctcatctctctctctttccatctgaaacacaataacgccaatcaaggccaattgcagccactagctttggctctcttccgactttgagccaatgtagcatcgtcaggtaccgatctgtgtcaaaatgcggcggctccgtcgtccatcccctccgccgcttctcgccgaacttaccaccgtgttcgctcctccaccgttaagctcgctccgcgaaaatccccgcgcccaaacggctagacgcggataccgacagggtaaaactcggacctacacactgggtacggtacgatagctacagtacatgctggccaatgttatgtctgctctaagttcgacttgcaccggaaccttgacccaaagattgcaagtgtatctggtgctggaagcctctttctgtcaatcctagcaggggtgtgggagaccaagaggacgaggaggtgacgatgaagaggcggcgacgggaatcaagaacggacgacgaagtcttcggatcatgtgtacacctgctcgtaccgacccgtgcccctgtcgccacagctattactccgtccatttgctcctctgctctgcaagtttctgcgcgcatagaggttacctgccaaaatgcgaaaaaagccattccgaagatcccgactgggggtccaatggcagtggggaaatggagtagacgagatcaaccaggtcgcagtccaccgggcaacccaccggacaattgcgctctgcctggtgacgtccttcactgggcacgtcttactggtaacgtcttattggtaacgtcttactggacaacaacctgggggctcgcgacctactgtcggtccacttcgatactcgtacctactcgaactcacaattcgttaccccgtacatcagtcatgccgcgtgatgtcaccccacagcccaacaaacacagcaagagaaacccaggaatattatggacacacaaagaacaaaaaccgcgccatcaacgcctcttctggacgaaacctggccccatctttcggcgcggtcgcagagtcgtgcctcgctaatggggccctaaaaacaaggcactaaaaaaaatggagaccttccccaactctattttcccggcgagcgccgcagaacaaaggtcggaggctaaacaagacaagaaagccagtttcggtgctttttcgaaaacctagaatgtggtaccggctcccctaaaaaagtgtgccccaagagagtgtgcctggtgtgtacataagcgagtagctctggcatgccacttgcacgtttccccattttcgtccctagctaaaccaccgccacgccgccgccacagctagctaccacagcgtcttgttcgggatgagaatacgcctatctcgcggccagatccgcctcaccaccctcaccattctctccatggtggtggtgtttctcgtctacgcctccttgtcgggagtgcgagtgcagggctacgaaatccgagtgacgcagaaggactccagtccaaacggtgacaagcaccacaatgtgatgcacaacgtgcacgaagcccccaacccaccccagaagaaaacgcagaaggtggtcaacacccacaacatcaacggcgactttggcaagtccatagacgagctcaaaaagggacacctggaggaggaagaggccaaggccaaggagctggaggaacagtaccagaaccgaggcgaggcccaggccgtgagcggctccgagactgaagacgaggagccctcccacacggaaatcattctgccgtccaactcggccacccccttcgtcatgaaggccccttctctcatgcattcgtcccctggttccaacccagaccccaacatccaaattgcattcgactaccccgctctccgtcagcagacggagcgagccaacgccactctagtttcgctggtccgaaacaaggagctcaaacagatggtgcgcacggtcaagaactacgaggaccgcttcaaccacaagttccgctacgactgggtcttcctcaacgatgagccctttgacgacgactttatcgagacaatgacaaacctcgtgtcgggtaaagccaagttcggacttgtccctaaagaacactggtctgtaccctcctgggttgacaaggagaaggcagacaaggcgagaaaggccatggccgagcaggtcatctacggagactcggagtcataccgacacatgtgccgattcaactctggcttcttcttccaccatcctctcatgcaggaatacagatactactggcgtgtggagcccgagaccgccatccactgcgacgtcaactacgacattttccagttcatgcagaccaataacaagacgtacggcttcaccatcaccttgctggaaaaccctctcacggttgcgtctctgtggcaggagaccaaggcttacaccaaggctcatcccgaggtgctggccaaggataacctgctcaactggctctcgtacgataagggtgagaactacaacatgtgccacttttggtctaatttcgaggtggccgacatggacttttggcggtcggaggcgtaccaaaagtatttcgaccatctggacaagtccggtgggttcttctatgagcggtggggtgatgcgcctgttcactccattgccgcagctctgtttctgcccaagagcgaagtgcatttctttaacgacattggatacacgcatcctcccttcactcactgtcccattgatggcgacacccggaaggagggcaagtgttcgtgtcttgctgaagagacgtttgattggaagccgtgctcgtgtctggggcggtatctggacgttcagcgaatcaagcggccccatgactgggagaactatagtgactggtaggaatatttattgtaacatattatttattaattggcacactttggtgctcgagaccgaaactggatccgtgcagctctctgatcgacggcctacattcaaggcggactgtcttgttacagcccgaccaatgtcttgtctcattacagctcaacaatgtcttgtaccgttaatgctcgagtgtttgacaatgtctgacttgatggttggagatgttcatgactcgatacagctcatcagtccaggaaccggcagcgttgcatgcaatgactgcaatttcgcaagctgacgattttccggtctttgtttcgagccagcctccgcaacccgtgtcattgtgtgcccaggttacattgttacccctgcctctccacagcttgcattccgtgtctcagtattgtgagacatgttttggagaatgacgtcaattattttcagagtttgggttatcggatgagatgaccgtggagggagtgcggagaagacaggtgacgatttgtaggacgcggataggagaaagaaggagaggtttttttgcgtctggagcgcacgataagcgattgatatatggtgcaaaagatggagctggtcgggagcaaaccgccgggaacctggtagctcttcatcaacacactctttgaactggtgcacagcctgggtgccgtatgaagtttaccgtctcagaactttgagggtagcgtgaactctttgctaccagagagtgtgcgaggaggtgtgaccggtcctaggtctcggtaggattgctttcttcgcagtcgttagctccggtttggataaggtgttggttgcttctgatgcgactccccaaggtacacccagtacaagtgcagtacgacgttcaagtacatacagtacgacgttcatgtacgacgttcatgtacagtacatagtcatagcgatatgttgtacgacactttcagcattccaattcactaaatcctatccacttatcagatcattcaccaacagtacatgtgtacatgtaaacttatgcctccaactcccctagaagatccccaacatcgcgagaaacacacctgcacacaatgccgcaccgtcgtttatacggagcctggatttggacgacccgcgcgtgtctcaaaggaggaactagtggcagattccaatggctcacaggctcacaaaggggatcacaaagcttctcgtagtagtcgactagcgtttgtgtttgggatgcgtgggttctgggtaacgagtccagttcgtacgtccgagacaactccaacaaacggccatatgtagccggcgatcttgagaagaatcggtcggagctggaccaggagttgccagagccactcaaccgccgtctgtacatatccgcgctgtcggggctggtttggggggatcacagggatggtcactcgacctggaaagtggtgtgtgtgtcggggcggtccaaacagtcggttgagagttgaatcctcgttctctcgcagttctctgaggattaaagagagccgatctggcgtcataacaatggcggggaaatgggtagaaacagcggaaggcgcgctgttagatgagggttctttgaaaggtgctgttggacaactctctgtgagtgatgtaaatatcgagggttcctgggtctactttattattccagttttaaatacaagtagactgtttggggtacaaatgctgggactgtagctatatcgacttcgctattggagtgacatactgaagaacgactgaatgagtgctcaagaacagctggatgagagctcaagaagtctacagtattcgcagcaaaataccccaatgaagctctcgaatgattaattgtaggtctcgtacgtaaaatcgcatcttttcatgttgctctcctgatagtacgtgctctcctctttttctccgttttttccccattttcccatttttctttgatcaataatttaattcattactatgtacatcaaatgctgaaaacgtcaaattcagctgatttttccgagtcggggtttctaatgacctcatccaggtgcttggaccgagacacggccttgtggatctgcttcatagcctcctcatggtagaaagcctgagcaacattgtggaagaaggccagatcgtgcttcttccagttgaaagtggcaggcgtagccgacagaatcgcagcagcttctccaagctgtttcagggcagccagagcattgataatcttgagcgcaaaattgtagtctgcgctaatctgctgagcctcagtcctatacttgttcttgtatgcatcggacttccgccacttgcctcgctctacccacacgtcctgggaaaattcaagtctatcggtcatctcctgaggggtgaggcgtctcaaggggtggttgaggttgggatcccgttcactggcatcagcaatgcagtcagcctgaacagcgttcagggcaataaagaaatgagcatcagaacggggggcaggagagaactgagtctgcaaatcgtatcgctgaggcttcttctgtcgagcagagtaagtcttcatctcagaaggactgataacagcgccctcggcttctccagcacccacagaaacctcgttgtatcgtctcagaaactcagggaaatctctatgtctagctcccgccttgagatagtcagtggcagcaatgttatccagcagctgaggcttgttgttcttcaagaactggaaaatggctcgagattcagcaatgatcttcttacggtcgaaagaaagactttcaatggtattggtaggcaagaaaggagggatcatgccgggatgctcctcgttaagctgcaccataccctcaatatcagggaacaagaatcctcgcatcatttcttgagcgttacctccataaagacggccccaagtagcccgaagagcagaagaagcaactggtttggtccgtgtgtcgtaccgagcataagcctgcatcagaagctgagtcagaatggcatcagggtacgtctcaggagacatgcagagctgcttgtagagtgatcgaaggaacaccaggtctccagtgacggctgcggcctggaaaacaacaaccaaagtgtgtctggagtagaaactctcactatgttgttctctgagctccaaaagaagctcccatgccttgagatgatacttttcctgtctcaaacaggcaagaatcagcgattgatatgttctaacgttggcaaccgatttctgtttcatttcctcgaacaaatccaatgctcgttcggtattggaacgaatggcagacgctgtaatcagcgagttgtatgtgtgtgcagttggctgggtctccagagaagcatacttcatgtattcgaagatctgagatgcaagttccaccttgtggtttcttagagatgtggaaatgagggttgtgaaaatgacctggttgggtcggataccgtagagttgttgggctaatttgagatcgtcgaaaatctccatggcctgcttcagatccccccgtttatcgcatgccttcagtcgatgcgcataagtatgtacagtaggggtgatattgttatcaatcatttgtcggaatctctcctccaccttttccacgttgccgtcctcggcgtatcctaacatgacctggccatacgtgatggcagaaggcttcactccccgctgagaaatccactcctcaatctgaggcagaaactgcgctcgaatgtcgaccgggatagtcgtcatcagagagttaaagtctggaatctgaaacttggacgtgttgagcgtcgaaatgacatgtttccaaagatcgttttggtatgcaggggtggaaatgtgatggctagcaggcgtggctagcaaaagttgcgtgggcgagccagccatggccttggctacctgtctactcacatgaggcgtgagcttggactttgccaggtactccatggggctctttgtgtcatgcttgatgggtgcagtgtgtgtatttgctcccgacggtctctcttgttcagctggaggcagctccttgtgctgttcggtggcttcagcagccttgtggtcgctcatgagtgagtcaaaaagactgtcaatatcctcgtcggaaacgtgggtcttgttctccttgagaggcttgtcgggcgtctcctggacaaacagctcttctttaaccggcacatcaggaaagtcgaacttgagctccgaacgaactgcgtttgattttcggaacctggaccccagagcggtgctgtagcatctgtcgagtctgtgcactagagctggtcgtaccagcggcactagaaggcgtgctctgagcatttttttttgagcggttctgtgtacacttgagctgtagtgttagtggttctgtatgattttattctctggtattttttgtactgaaatcatgcatggtgcacgtgagttttttttcacccaaggccaaactggcgcctctgcttttgccacagtggattagggctttgccaccaaactggactacaagaaccttgactaggaagagacggcgtgggtttctgtgcgttggcaggatctaatagcagacacggccattaaataatgctgaatgcggcaattattttggtaccaataacagctgcaggtcctgctaaaataccgggtccaacgttgttaaagttgtcagatcggggtggcttgaagaaggaagagctacacattgcatcttttcacgagtgtctcgaagaatgtcccgtataaagagtaactgagtaacttgcggcggacggaaacatatctcacgaccaaatgtgttcatgacgtccgcgtctttagattcttgatgttttcgcccggtgttgtttacacctttgggtcgtgtgagacagggtggggtggattgagacaagatgatgactaaaaagtctccaaacgaatgtcgagtggggagcggggaacactctagaatgacgggtagagacgaaatgttctcactagactgcgagcacaaccacagtagctacaatagtaatagtaatagttaccgacactgcatctacagttcggtctgtatcataatgacccagtatcctcctggtatgaaagtcaatgcttaagtaatcactcacattcagctcactcgtacttgtagacgattccacttcatccaccattcatattgattacatatacaatgaaaggatcatatttcgaactctctggcaaaaggtggggtgggtggagcttaagcgaaaagctaaagagtcggtcgatgaactttcgggcagatgatttgacatctactacaagagcctggggatggatttcttccatttttttcgatgaaaaagacattaaacccacgttttttcgatttccccagcatacagctcccaggatcttgtatagaggagttggcactcacacaaacccccctgccgcacacctattaaaggtacattccagagacgcgcataaccaagagtaagttaaacatggatatagagataaacatgaagaaaagatacaaatacaagtacaataccggggtacaagtagctacttgtaggccggggtgattcttcgacactaccgctcagtcgcttgctcgccatgtctgcaccagctgtaccatcaggacactcttatgacgcggctgccatctcatcggtgcttgcaggagtgcctacagaagtgtgggttagtttacagaactacgtgggggccatgagtactccaccacctggatctactcttcaaattcccggcgccggttccacagccgtccttactgcgtctcctcaaaagcagaaaaccaattcagcttcacacatggttgttccagctattctcgtcgctgctcctgcgcttgtgctcttgatctagcataacaccactcgatctcgcttcttcttatgatctcactactcatgatctcataacacatctacgacccacacattcacttctacaaatctacaaacacaacgacctttcgttattgtacagtcttaatttattcttttcacaccaacaatgtagatgtttataatggtcctccctgactgactgcaacaagtactagctgtctatgtatctagtttcagcattgtcttctgtgttgggttctgatgtgcttccagataatgttctactggagcatcttagttcaagacagtacgagtacaagtagttagtattactccaaaactatttttattttgaggactacaaaaatcaacattacaatacaaaaactacagtttggaaaatcgggtggaactcaatggtccaagatttattattaacccaagaggttcggaatttcacctactcctctctaactagataacaggttcggtcagttacatcctctgccaagaggttcactgcctactccttcagtatgacttcagctcatgctccggctcttatcgctctttggacttattggctactggctggcctcggctcttgggccctggctcctttggcttatttctggcgttttgcacttattgcatctgtggactcattggcaatgctcagcgaccgtgctcttattgccgttaaggacttagtggctttggtgctctcgtatggcacttattgctctctggctctttgccctcgtcttcgctgctattgctcttcggacttagtggctttgctctttggcggctctggcggctctggcggctctggcattcgctctgactctggcatttcagctctagtgactggcgtaacagctctggctcttgagtggctctggatttggcacttatgcctctgcgggactcacaggctctgactcaggcatctattgctcttttgaccatgtatggcgtctgtctggcagatctttgctctagtttcagcttttctgctgtagtggctcttgcatttcagcttggctcttcagttctaggcggctttctcatacaggaattgcaccctatgagactttcacaaaggagtttcaccccgtgagtatgagtatctcgaacaggagtttcgcctgtgagaatgatggtcctctcaaaaggaattgcacccttgagtcctctcagtcggtggctcgggctcaatggctctggcactttgctctggcggctgcaaatgcggttctaaagaactcacaaggcacgaaggtggttctgacatttgtcagtcagcacaatcactcgctctttgctcacggcacttttccagctcatggcggtcaaccggacacaaaaggttacggacttaagacacttggctcaggcggttgtactcgcttctgcaaagaactcgccgatttctcagctcaaacgctcaatcaggagctgtcgcactgggctcatgcgataaacgcgtcattgcctttcttaaccgactcttgggattctggaatttcaccacattgcccaaaaacaactcaatcggacggcaaaaaaaaatggaaacgtcctcgctgtagacagatcaggtcaactgtctggtgagacaggtctgcttgtcagctctgcatctcagcaggctataaaaggcaccttccgtctccagaatggctcagagtaaactggtcacattctgaaagaaaatgtgggtcgtggagggggtttatatattcttgaccgagccctttacagttcgacagagatggctggtggcaaaaaaatacgcatcaaatatgcatcaaatatgcgtaccagccatataggtgcatgactcgaaacagagagaaaggaaaggaaagttgtagaagcgtagaagcgatacagaaacaacaattatcagataaaaaaacagcacgatcagaaatatatagagcaagttacgccttacacccattccagaatgtaccacagtcactttatactcctttacacactcccttcatcgtctatcccccttgcatatacgagaatcttattttaaacctatgtagccagccgcttccaaagaacgctgaggaatatcagcacttttgtaagccgctcgaagcggaaaatttccaagaaaattacccggggatagagctggtggcaaaaagagggtattcggcgcttccacatatccgaaaatatcttctgaatatacaactgaaaggtttgagtttctacacaggcccacatcatgatggtgaaagcaggtaggggacagaacatggcagattatggaaagggcaaaaaagggaaacaagaagctccgcaaggggcaaaacaattgcagcacccaggattctcgtatggtctcccactacaatactaactaggctctctggtgcttgactatggctgatcggacgggaagccgtattttcaccaggatatggccgcaactgggttcggacaaaaggacgaggttggaattgggccttgtaagccacgtgacagctaattcgaacatccacgagctgggttctctaactggatctctcacgccagtagccattgggccaggtatgtacgatggtgcagctattagtaactaagacactcttcatgtatccacacatgatcatcacacgtgacttgattgtacgactaggaataatctgacaaacattgaatccgttcccatctgaaattttcccaggttagccaaacgataatgcatcaccctcaaaagactttgagggctgggtctagagctcgtcaaactccttagaatgggttttgttttgatcctccatctccttcttgagctcagctacatccttctaacgctcctcaatctcttcctccttctcggcgagattcttctgcaccttgtcgaattcatccttgacttggctgttttaatgcggcacctttcagagtgttcaggagccgagtagaggtagaaagataagaaaaccattggaatggaattgtataatagattcgccaatatcggtggagccatagactctgcgaaaatggtggtatactaatcgacctacttgagaatataacccaccggtagggtgtgcccctccgcgaacatacatacaaacaggaatcgataaattatttcttctcggacttcttgggattgctagtcttggcggcggcaggcttgtcggcaccaccctcaaccttcacatctcccttatcggtcttctccttggcagcctccagcttttcagtagcctcgttcagctctttggcggcctgctccttgacggcagcatcaccctcagccttgacaactgagcccagctgctgcttcatctccttgacgtcctcctcctcgctctccttgccaacacccacaatagtgtcggttttcagcagaacgcccgtatcatcaccagtattctggacattctcagtgacaatctcctggaagccgggtttctgctcatgcttgacctcgcctcgcagaatggcctccacctcggtctttcgcttcttccactcgtccaccttggacagcttctcctcaagcgattggatctccttctccacactcagacgagcctccttggatcccacaatctcaagatcccagtccttgccgtcgttgccgagacccagcttgagctgggccttgtggtacttcatcagagaaggtcgatgagatatggtgatcagagtaataccgtccttcttgcagttctcgtaaagggagccttccacatcagaagaaacagcagcagtaccctcatcaataacagcaaacttggggcgatggtataggattcgggcaaacatgactcgctgcttctctcctccagaaaagacatccttccactcctttcgagtgttccagccaccctcacgcgagggcaggtagcccaaatggactcggtccagaatagtctgcagatcagcatcagtgacgttcttgctgatcatgtcggcatgcgaatcggggtagataatctgatcccgcagagatccaatggagaggtaggctcgctggggcaggaaaccaatctcggaaatgtcgggacgagagagcagaccacggtaaacaggccacaaaccgccaatgactcgagcaactgcagacttaccgcagccgttgggtccggaaataaggatgtgttctccgggcttgatgagaacgttaagatctcgaacaagcaactcaccagagccgacagcagagggtgcaacaatcggaacaccctcgaatcgcacaccagggtatcggggctgaatggtacctgaaatggagttcagagtgaactgctcttcctcggagagctcactgctgctgtcgggatcgggcttctcgccgataacaatgccctcctccttggcctcctttgaagcagcctccttgatgggagtcttgagtattcgcgaggtgtaagctcgagcatggactcgatgcagcaccgaaagcagcatgtagactcgagaggtgtaaccggacagctcggcaagatccttgatggaatacatcattcgtccaccggcatcggcaagggacaacatgagtcgcttgttggtgatgaaatctcgcatgtggtcctgctcagagaaatccatggaagcggtaacagcagatgcagtcgtctccttggtcttctccttgatggaggtccatgcgggaaggaaaactggcaaagaggcaaacatgtatccaatggcagaccaggtgtacttcagaatgatatcctcaaacatgttgtagaagattttgattcggtagattcctcgaatgtgtcgagccagtcgaatgtatgccttttcgagaatagttcgctccagggaagtaccatcgtagaaagcaatttcctctgcgttggtgatgagcttggaatgcgctgctcggtactcaccctccagcttggcctgaatggcggcaagcttaccgaaggaaggggccagacgtcgcagcaggtatgcagtaagaccgtagttggcgaaaataccaatgagggccatgggtcccaggttcttactcagctggaaggtaaagatgaggaagtccacaaaaggcttacccaggtttgagtacagtgctgcagccttgtcacagaaccgggccagatctgtggtgatgaactggtcggcagaagtaccgacgttgcctccatcaatgtccgcaatcttgtagtatgcgagatcggcatccaaatacagatcatgtacgtatcgggtaagacgcgttcggaatgccagcgagagcttggcctgcaggtacttgatgactgcgtttgtgtaggatgcagggacggcgatggcgaaccagtagcccagtcctctgaggaacttgcggccgtctccggcaatcatgtctcgcacaatttggccgtcgagcttggccacgagaagcgagatccatgttcgcagaaacaagaacaaggcgtgcaccagcagaatgagggattctcgggactgcaatcgggggaccatgatgacccacagcgcggaaaactgtcgcaggaacctgccgttgatgccagatttggcttctcctccctccgagtcgtccggtcgcagaaacagtcgtcgatgtgcctcgaacgtgacctgcttggtaggcttgatggtcacggtcgtttgtccctccttgtatggcaccacaatctgcttggacccatccgacagtttcaccgcgctgtccattcggtgtaacggcaccttcttcttgctcttttttgtgttgagattgtccagcagcgcctggcccgcaatgcccgtgcatgagccaaccagcaggaacgccacgacagcaatcaccctcagacgtcggggagacatttgccgcagactcgccaggtacgtggagatgaacgcccgcaacttgacggggtcctgcagagcctcgatgagcagcggtcgtagtgtagagacgtttgccatgatgttagacggggtcttgagagctgtggctacgagtcttgtgagtcttttgtttgtcttggtgtcgcacttgttgttgtatcagagtcgttggtgttgctgtacccgtctgtcgctttgtgtgtatctgtaatgcacctgcttgctagcaaccactagtaccgtccaaaagttgacgttgtagtgtcacgttgtgcgctatgttgcggggaggagtacatgtacagattgcactttaagttttgggacttggggttcatttaacttcctcggttcggcagacagactggggaacgacgaggccgaaagagacgaatattggtaggcaacatgggccggagaagacagcaacttgctgttggcgtccattaaaacggttatgccgcttttggttttccattagcacaggtttaagccgctttagtcactgctgcaagcggagccaccctactcccgaaagacctggaaaatgaaaaaaagcttgcctccaatcaaagcaagtgtaaatgacggcaacgataaagaatcatctccgggagaggcggtcggtcacgtgatctttggacaacgaaccccgacaaccgcatcggatggtgaaccgctctttgcgcccctgaaatcgcttacgtaatctcggtgtgtcgacttttcacgagcccctcttcgtattcgggtttaaacgcatctatgcatgagctggggtaagatcagggcgttgtcttaagtaaaaggttcaagtgtaactctattatagatggtcgggttacttagtagttaggtggtgtggtgagcattccatatgaaagggaaccgatatgtgagcacaccacgggagttttcggttaaaactagagtacacttgctgtgttatcaaatatgcgcacttattcaaaggcaacctgttaccagtggagagttgtggtcacagcgaaagagcgactgccgtgctcttcagattgggcatggtgtttttgatctcctccacaagatcaggttcaatgaatccaagacgcagggtctgaacagaaggaaagatctttccgggtggctcggcgctgataggcattaatctgctggtgctaaaggcgcttcttgtgatatcgacagtcttcagcttggtcagtcgagatgcggctcctatcagcatatgccacgctatcagaggctgagtgtcacgtgaaatgaactcggtgagaccactgggaaggtcatttgagtcgttgactagggctgtggtaatcttctcactcagcttgagtgtagtgatcggcagcttggccatccaagagtaatctggcgccggtgggatctgtagagacgtctggaggtcgtggtctgtgataggcgtgattggcgaagcaaacagttcgagatatttaatgcgagtcaatgcaggggcgatttcagccagagtctggtggtcttccgatccccagatgaggctgactgggactcgcagaaagatgatttgtttgagcgactcggggataaagtatttgatctgatcaacagaacgcacctggaccagcaggtcggccttgtattttgcagcgtaggcactgagttgggacacgacgtcatgtagctgctcgctgaggtctgaatcggccgtggtgtgatctatggtcatgacgatggagattttgttgatatttgtaaaaactgatctgttgagaaatgccagagccgccaagaactgctgttctccccaccagggcgtgaagctgaactcgactgtccgaaccgatgacgacgcgagcatcccaacctgtttctcttccagcgcacccttgaagcggtctacgttgaggttgtgtagaatagtgaagtcatcgtgacgtggtaacaatcgcgtctccacatagtgtttcggcatctgggtgatgtgtgtccatagtaacgggatgacgttgttgtagagaccttgacaggtgcatgcaaggtggaccagctgcgtctgatcctcgacgtatccagcaatgatgcggaagatttcgtgcggcaagttctccatagctagcgagagattgaagctgcagttgtagctggttgtggagtggtggcaaaggtgccggggtagtgagagtggaagaaggttgattcgaattcgcttccgataagataatgcatgtatagcgctgcaatagggtaattggtagggtggagaagtgaatgaaaagtcagcatacaacttggtatatgtgctgtaactggaggttttgagaccaaggctgttgaattgggccaatagtgtcacctgtcaaggtcgtaatcactccaatgtcaacatatttccgagttcgaggaactctatcagagatggtaggcgtatctcagctatatggagaaggctgctggtttatgggtttttggaaacagacagaatgtgtattgtttcatttcagaatgtgtagtgtttccattttgcatcaaagaagcactgttcctgttggactggtttgcgtcaaatatacctagagctcaactatcgcgcgcctcactagtctgatgtcgatgacggcgacgacaactgcaacgataatgataagcaccagcttgtccgtgtctttatttctttctctgttcaacttgactcttcctttcctgatcagtccagtcactcaaggtagacgttcctgacaaacgtcttgaggacctagctggatgctattcaggtgatgttgaacagaaaagataccaaagttcttgagccttgtgtttctgcgaatctggagcccaggataactaggtcgtaagtcgcaacaatcagaccttctccattcttgtcgtcagcccagcacgccaatgagtagagagcacttgtcttcaggttccagatcttgaacacaatctggtttatgtcaaagacggcttggcttatgtcagaaagacactccgtagacggcgctgagacgaatgtcgaattgacatccctatcttgagaggaatcccatcaacagtatgtagtacatgctgtagaatagtgcgtctttccattccagatggttgttggtgcaacgatagctgtcccccgtacgattccggaacgataactgccaaccgtacattccgtggaatttgatcaaaaatcatctgataatatcaacaagtaatcatcgcgagattttgcccgatcaatcgtaattcgtccctgttgcgtctgccaagcgccgtgtggcaagacgcgcagatgagataaatgagacgatacaatgtatatcgaggtgaatgggaaacagagaaaggggccacgatatgtaaataacatgtagaggcacttgaaggcatgtagaaatacgacactagcctccgtttctgcatccggacctcttcttctagggatatttcactccacactccgccgttaaacttgggtggggttcgtgtggccaagagtgcatgaaaacatatatctggtagagagagaaagagggaaagagggaaagagaagatggtctctgattatcaccacaaaccccacattctttccaccacatcaacatgtctgtttggtccccagaatcacctgttttctcctacagcgagcgccagaaccacctgcttccccggtcccacgaagatgagcccttgtctcccacaacggagtatgcacacgagctgacccaccaggcggtccagtatggcagccaaagtcctgaagtcagcaagatcgagatgaccgaggactttactccaaacgccgggtacattgaggtcaagcctccagcccgacctcgtcagaatatcgccaaggataatcagcaaatgcgactggcccttctgcgagtcaagagatacgagaccgccgttcagcgactgcaggaggaacaggatagagaaagacagaccgcccgacaggctggaagggatctcatcaagtacacaacgtcggtcaaggaccatgcggttccagagctgtgggggtatcttcccccggagaagaacccttatgccctgtatgaggaggagaacaagacgaccggatgttgtgttatttcgtgacccgcgccgaataaacagggaccgttttagctgaggtaataaattgacgctatatcagagaagctggagcacatgtgcgcccgaataaatagcacaggatggttgcaaaagtggtgtcattctgtggcatgtctgctcaaattgcaagagtcaacaaatcatcaacaagctcggtgtcagtatactcaatgccccggttgcgcatctcgtcctcacaccatcgcttgtgcatgagagtcgcaaacagagcctcgctccgagcctcacgaatctcacccatcttctcaagactaattgatcggaactggttcagggcccgcacctgcgttaaaagcgcatccgagtggtcagtgcccttgagctcgtcgtggatgaacaagcacgacttgacgcaaaagtcaatgctctcctggagctggatgacaccctggccaatccctctgtctctcttagccagagcggctcgctcgtccagatattgttctcgcagaagcttgagctcgtggtcagacgcggaggtgatgtgctcgggaacttggctaggttggttgaacattgatggtgtaatatgtgtttagataaagaggaaagaggaatagtggccagctgcctttcttatatctacatcaggaacgttacatgaggcacactaccacatgatacctgtgataagggagttgtaaagacgtaattgctacatctggttcagaatgtctatatataaacccgttagcgtccaataaattacctacctgtgctgattacaacttcttctgagcctcggtaaagttgggatagtcaatgggaacattgaagcccttcttgacctctggaattgacagcagtcgagtcagccacttgtccaactcagggaactcgctcaagtcaataccaatggcttccgaacgctgcacccagccaacaagagtaatgtcggcaatggagatgtggtcaccggcaagatatccagtgccgttctccttcagacgggtgtccaagacgccatatagacgcttggtctcgtcggtataacgcttgatgccatactcaattttttcgggggcatagatcttgaagtggttggcttggccctgcatgggtccaacgcctgcgttctggaaaaacagccactcaattgacttgtaatagtccagggtgccctcaggataggagattttgtggtctttgtcgtacttggacaccaggtactgcagaatggcgccagactcgaagatggcaaacggagcagaagaggtagccccgggaccctcggtatcggtgatggcgggaattcggccgttcaaagacacctttcgaaactcgggggtgtgctgctcgccatttttgatatcgatggaaaccaccttgtatggcagcttgagcagttcgagagcgacggagatcttcacgccgttgggagtgggccaggtgtacagtgtgattgccattttgtgtggtatttggggtgttgaggaagagagagagtcagcctcggtgtcaagagagggccttcatacactggtggtgtggcttgcttagatgacgcattatcaccaaatcttaaagatcaccccacacttttgcctttgaaccaccgaaatttcaggcaactaaactcccaacaaagtactgggatttaggactggaaattgtgaagaaaaacagaacaaaaagaaacaggagcagatatggcgccacagttggtgagtatgcgcgaacttttctgcagtaaaagttgatctgctgaaagaagagcataacaagtacgactggtgagttgtgggtttgtcgggtgcttggacgagtccatattgaatctttcactttcgcagcatggtcactcaccgaagaacatatgtacaaagtacgtactaacaggagaccgcaaataacaatgcgagcctccgagagtcgtacttgtagtagttcttacagcttctgcaaaaccataccttcatatttggtctcacatggttacttttagttccagttttctactcggaacctcacaacgagcttagtaagcagagactacggaattccgagccactcgcccactcgtccactatccactcgacactcacaggattcaaaaaacaattgcagcacctaggattctcgtatggtctcccactacaatactaactaggctctctggtgcttgactatggctgatcggacgggaagccgtattttcaccaggatatggccgcaactgggtttggacaaaaggacggggttggaattgggccttgtaagccacgtgaccaccgaaatttgccgtccgtcggaagaaaaccgtgaagaaattccactgtcggtctattttctgtcgttatcgtgtcaattgagtcttcgggaacgtactgtctgacgtatgtgttgtcatgatactgcaacagccaattatccatactagtgtttgttgattactcttacacatcaatacatggcacaggccgtcttaactattcaatactatatacattaggcgacaacgtcacggatggaggcgaggtaggtcttgtaagatcggttctcaaaggtctcggcaatctcggggagcagcagcaggaaggtggtgtcgacacctcgagactggatgtagtcctggatagatcgctggagatcctcgtcgagagagtagaagtagggaccctcgtaggcgtttcgtcgctcagcagcagtgttggcgtcgtcaatggtggcgagcttgccgtccttgtagggggtgatggtggagatgatgaactctccctcgtcaatctggccgtggatggacagagcgccctgggcggctcggtcgatgacaacgttgatgtccatcatctcgggcatctccatctcctcagcactctccacctcggcctcctcggggaaggcgtcgggggcaggctgggcaacggcgcccagagacacaaacactcgggtgacgtcgccgttgtcaagcttcttgacaagctcgagctcgtccttggagggggagtagacaatctcgaagccgctcttggtcagctcgttgtcaatctccttgggaagtcggtactggccggtggagccggactcctcggcaatctcggcctccacggagttctcgtagtcaatctccttggtcagtcgagccaccagttcggtagcaatggcctcggaggagaaggcgggtcgagaggtgctgagggctcgagtgaaagcgggaacagcaaatcgggtcacctggggagcagatgctcgcagggcctgtcgcacaatgttggaggcgttgattcgcagaattgctcgggacatgatgtctgtggttgtgtaaaaaactgtggacttgctcaaactgaagggggttatcgttcgttatataattttattcatgcatgctgcacgtctcttcagggttagggctggaaaaccgcactacaatccattgccactctctattgggagacccaatcccaatcaagttttgggcagtgtgagaagcccatagaattcccaaccaaaaaaaaaaaaaaaaaaaaaaaaaaaaaaaaaaaagggaaatctggggcagcgctaaataagctcgtattttttaaaaaaatgtttgtttttttttttagcagaaattcgccaccaaatagaaaatgacttttgttgaacatctcaactgcacggcacgatatagaagtcttgcaagaaatgaaaagaaatctgctacaaagagaaaagcgggtacgagtggaggaagaggagtaggtcgccaccatatttggcgggtcagtttcccaattgagcaatctacacatgcctctgcatcttctacaggttggtacatataatttcaagtgactagaggttacagaatgaatgaagccgtcgtaagagagcgcattcaaaattagtgcttgagagtctcgttcttgagagactcggtggcgtagccctctcgagcagcggtggtgttcttggggtcggcaacgcctccagcggcctgtcgggcctgcttcttgagagcccgctttcggatgtcgacgtgcatcttgtagttgaagccggcaacgagcttggagaagacgccgacggtctgggcgatccaccagtgcagcagggcgtgggaccagtagggggtggaggtggcaaacttctcctgggctcctccggctcggccaacggacgacagagtggcggtgacaaactgcttggggttggggatcagagcagaggtctttcggaccttggacatggcagaggtgacgaggtaggagacaacgagctcgacatcgacgtgctcgggggcaagctccacggccagagcgttggaccagtgctggaggaaggccttggaaccagagtaggtagcgagcaggggggtgggcagcaagccgccaaaagatcccatggtaagaatgagacccttctggaacttcttggtggctcgggcctccttgacggactcgacaatcttgggggcaatcagctgggtgatcttcagagtagccaagttgttgatggcgatgatgttgtgcagctcggcggggggggtctcgaggaagggggtggggatggagtgggacaagccgacgttgttgatgaggatagacacgctggggatggtctccagcacggtctcgatgtccttgtagttctggggggagtcggtggacacgtcgatggccaggaacttggtctcgaccttggacttttcggcaatctcctgggccagctctcgcagcttggactcggttcgagaaatgaggaacacgttgaagcctcggagacccagctgtcgggcgtactccttgccaatgccgtcagaagcaccggtcaccacggcccaggcgccccgctgggagccgtagggcaggtagttggtgggaggcagcacaaacacgtcgagaagaacggccacataggacaccaccttcagagccacgtggaagaggccaattgccagcagaaagacggcaatgatggagagaccatggtacttgatgagagcagacagcacccggtccgtgttgttgatgatcgagtcacaaaagtagtttttcgcgttcacgtagaccattgtgagggttgtgtgagtagtggttgagttggtgtatagcaaactccaacctattaaaataccatatgcactctgccacttctcgggtatcttgacgcaaggtcgtgggacattgctgtgatcgacacaatccattgtctatagagttccggtttattgtccgggttgtgcgacgggtttgtggttctgagtagtatatatagcgcttgtttcccttcgattgggcccattcccttcaattgagccattttttcttcttgtctcatcccagcctttctgccagtcgctagcgtctccgtggagggactctgacaggccgccccactgaaactgtccaatgtctacatgaaaccggctagacgaccttgagtttcagacgagtggctgtgaccggagcgctcatacaacggtgtgtaagtacaggtactgtacgatattgcaccatgtactcgtgcgatattgaagtatgtactcgtactcgcaccgtacctactgctcatgtcgtgaacagcacgtgggaagagatgtaaaaagacgccgcagaagtttatctgtacaaggagatggacttgtaggttgtagagtaatggtaaatgtgtccgttagagcacggtttcacgtgacattttatggcttttatgggcattttatgaccattgtcgccatgctgaatcccccagacttgttgttttgtcagctgctcctctggaagacgagttatggccactgtctccattcctcgttggtggagcaaggcagatggatagaatacgatcttgtacatactgtacttggtcttgtagggcaagtccaggggttagggatactcaagtggtgaattccggctcattgatgagtttggacttcaacgcgtcgctttacagcaccaaaagttgcacgcgtgtttgggacgctagcacggccgcctacagctattaaacctcatttcgacaaggtcaagcatttctagaaggtcaagaaagcttgggggcgcttgcgaatgcttggggacgccttgtgcggttccttcaaaacctctcattgctgatccgcaatactatggaactggacgcgggagcagcggaaacggcgctctgtcgggcgacatggcttggtcgtgaggacagtgcgagctgccggaccatggcagcctgaccggtttaggcggtgatgaggcctggcggagctgaatggcacgtttttgatcggcagattgaggtaaatgcccgatagacgtgggggggggcgaccatgacagattcagagatggttgccatgtccctaggaccgtgggttgcgaacacggagagaggtcgtcataccagaggcaggagttggccgtcatgttccgggacacgagtctttgacgaacgcggagtagtcgcaaaccccattcagcagtagcttgggttggacgccttcacgaacgaacggggaacggtgttgagctccgttcagagatggctaccaaatgtcgtaggtgagtccagaggttagggagctgcaagaatgtcctatgagcgagggacggcgagacaggtatacgatgacagtgacaacagtgacaacagtgacaacaaacgtaatgtgttaaaagtacagagatatacaggaagtagatgtggatgggccaagtatgtacagtattgtagcaacgagcaagcaatacaaggtttaaatacaatgctgggtcaagtctcattaatctggatctgagacatgaagacatgtcttataggtcagaagagcagcttttggtgagttcaaaagtctgactaagccgaattgttcagattatgagcaatatcatccctagtttggttttgtgggatagttctacaaactgcttacactgttctgaactgcaatatggttgcatttttgtttgtaggtgcactgtactcaactagttaggatctcaaatgagggtgtccaaatgagggtgtcataagccggacaacaacggaaactagttgtaataccacaagcccgacgttcgcaacgctcaaaaacagcttcgcagcaattgctatatatataccaacgcccttactccccacagacaccgaaagaatccctcctaaccctgattgtgcagcaactcaaacaacgttaatactgccaaatgtccagtgatatggttggctctcatcaccggcaatctctccagacatgaatctgttttccaagtccgaggacggctccaacacggctaccaatgcatctcagcccgacaacgtgaccgctggcgcagggtccgctccctccacagccacccccgcccccgagggagacggtaccaactctcaggaaaagactgagctcggaaagctgacggcttttgtcaaggaggacccccagaacacgtactacattgatggcgagcgggaggtggctcgaagcagcgtgtgcagaaacacccagcagggccgaacctgtctgcagctgctcatctcctccaaggtcatgtttcagcagatgcagaagatggtgagtatagacattggacggtaacagatgggtcaacacgcccaatggtgctggacgacacccttctgcctcatccactaacacagaacttttactgtgctcttacagacgaaattggccgaacagacatggagtgcaagtacgtcccatagtggttgcacctccccccccccatgctgtggcaagacagactctaaaaaaaattccatttcatatcatacacagaaatacaaacatatatatatacatgctttaacacaagtgtccaagcgtttggtctctacgcctgtgagttcaacacctccaacgcatggcccgtcacctcggccctaaccccttcacgcaccacatcggtctcaatgctggcatactcgccctccaacttgcgttttttcgcctccagaatctccaacgcctgattgaacgcctccagctcggtcaaacgcttctggataccctccgtttgggcagttttaatgtgatacggctccgacgctcgagacaccgtggtttccgatcccagataaaagtgcgcctcctggtacgcctggttggtgtgtgtcttcggagtacccaccacgggcgttgttggcgtgctactgtggtgtgagctgttgtgtctagacccgtttccgctgctgggcttcggaccatgcggtctagaaggagagtccttgtcacgctcaggcgggcgatgaaactcaccccttggctcccgcggtggtggacgaccgctgtgattgctgctgtgactgtcgtggcgttccctaggaccgctggggggccgatctctaaactcccgcggagagtctctagcatcacgctccctgctatcacgctccctaggatcacgctccctaggatcatgatcgcgtgggtcacgatcgcgtgggtcacgatcgcgtgggtcacgtggtggaggtctgtcacgtgactcccatggtctcggctcccgtgggggttctcggggccagtctctggggccttcccgaggtcctcgcgatccatctcttctgtagtctctcacttcatcacgtcgaaaacctgctcgatcagaaatctcgcgatcccgcgcgtactcctgctcgtaagcatgtcgccgttctcttccgtatccaaatctctcgtttccacggcctcttccgcgacctctgtatggtctcgacattgttgctggtgactgttgtagtggtgtttgaaaactctgatacaggttatgacgactggggatatcaccaaaccttgtgtgtaccgatactgtacagtatgtactggagctacgattgcacccttcagagtactgtacaagtatcggattattcatatatggaaaagttcgacaaggaacgggactgttgctccataaatggaaattcttagtatagtcgtcagttattcaccccacatccagtccattgatttccctaatctagagcatacagctaatattcttaactactgtcatcattattcctaactattatcaccactattggaaattttacttggacaagactaacaaattccagataagattacaactaacaaacagctacagtaaaagtagtacaaaataataatccattaacatatcaagtaatgacaagtggagaaaagacacaattgagaatcttagaagaggaaggcaacaagtgctacagagacgagactagcaggaatactgtagcgagaggccgagttggcttgagcggcaccggagccggtaccaaactggtcaggtccagactcatcagttcccaaaccagatccagagcctgagccggaatcagagcctgagccagatccagagcctgagccggaatcagagcctgagccagatccagagcctgagccggaatcggagcctgagccggatccagagcctgagccggaatcggagcctgagccggatccagagcctgagccggaatcggagcctgagccggatccagagcctgagccagatccagagcctgagcctgaatcagagcctgagccggatcctgagcctgagccggatccagagccggagtcggaaccagagccagatccagagccggaaccggagtcagatccagagccggaaccagagccggaaccggaatcggatcctgagcctgagccagagcctgagccggatcctgagcctgagccggaatcagagcctgagccagatccagaaccggagccggatcctgagcctgagccggaatcagagcctgagccagatccagaaccggagccggaaccagagccagaatcagagccagagccagagccagaaccggatcctgagccagagccagaatcagagcctgagccagatcctgagcctccgtttcctccagaagatccagagccagagccagaagtaccatcaccagatccagatccagagccagagccagaaccagagccagaaccagaaccagagccagaagtaccatcacctccagatccagagccgttactggaagaaccatctccaccagagccagatccagagccgttaccagaagtaccatctcctccagatccagagccagagccgttaccagaagtgccatctcctccagatccagagccagagccgttgccggaagaaccatctcctccagagccagatccagagccagagccgttaccggaagtgccatctcctccagatccagatccagagccgtcaccgccattgccggaagaaccatctcctccagatccagatccagagccagagccagagccgttaccggaagtgccatctcctccagatccagagccgttaccagaagtgccatctcctccagatccagatccagagccgtcaccgccgttgccggaagaaccatctcctccagagccagatccagagccgtcaccgccgttgccggaagaaccatctcctccagagccagttccagagccgtcaccgccgttgccggaagaaccatctcctccagagccagatccagagccgtcaccgccgttgccggaagaaccatctcctccagagccagatccagagccgtcaccgccgttgccggaagaaccatctcctccagatccagatccagagccgtcaccgccgttgccggaagaaccatctcctccagaaccagagccgtcaccaccgtttccgtcaccatcacctccagatccacttccgccatcgccgttgccgccgtttccagaagtggaagtagaagaagtaggagaagcagttgtgggagtaccaacattaccaccgccattcgtggaagacgtgagaggagttgaagatagagagtccgaggtgtcaccggactgaatcgacgtgggagcattggtgttagtaccatcagggattgacgaagtaaccgtgccagacacaccagtgtcggtagcagtagctccagtgtcggtagcagtagctccagtgtcagtggcagtagctccagtgtcggtagcagtagctccagtgtcagtggcagtagctccagtgtcggtagcagtaccggtgtcggtggcaccagtgtcggtagcagtaccagtgtcggtagctccagtgtcggtggcagtagctccagtgtcagtggcagtagcaccagtgtcggtagcagtaccggtgtcggtagcaccagtgtcagtggcagtagcaccagtgtcggtagcagtaccggtgtcggtggcaccagtgtcggtagcagtaccggtgtcggtagctccagtgtcagtggcagtagctccagtgtcagtagcagtagcaccagtgtcggtagcagtaccggtgtcggtagcaccagtgtcggtagcagtaccggtgtcggtagcaccagtgtcagtggcagtagctccagtgtcggtagcagtcgctccagtgtcagtggcagtaccggtgtcggtagcaccagtgtcagtagcagtaccggtgtcggtagcaccagtgtcagtggcagtagctccagtgtcggtagcagtaccggtgtcggtagcaccagtgtcagtggcagtagctccagtgtcagtagcagtcgctccagtgtcagtggcagtaccagtgtcggtggcaccagtgtcagtagcagtaccggtgtcagtagcaccagtgtcggtagcagtagcaccagtgtcagtggcagcaccggctgtcggtagcagtgtcggtggcagtggcaccagtgtcggtagcagcaccggtgtcggtagcagtgtcggtggcagtggcaccagtgtcggtagcggtgtcagtggcagtggcaccagtatcggtagcagcaccggtgtcagtagcagtgtcagtggcagtagctccagtgtcggtagcagttgcaccagtgtcggtagcagcaccggtgtcggtagcagtgtcagtggcagtggcaccagtgtcggtagcagtgtcagtggcaccagtgtctgtagcagtgtcagtggcaccagtgtcagtagcagtagctccagtgtcggtggcagtggcaccagtgtcggtagcagcaccggtgtcggtagcagtgtcggtagcagtggcaccagtgtcggtagcagtagcaccagtgtcggtagcagtgtcagtggcaccagtgtcagtagcagtagctccagtgtcggtggcagtggcaccagtgtcggtagcagcaccggtgtcggtagcagcaccggtgtcggtagcagtgtcagtggcagtggcaccagtgtcggtagcagtggcaccagtgtcggtagcagtagcaccagtgtcggtagctgtgtccgtggcaccagtgtcagtggcagtagctccagtgtcggtagcagttgcaccagtgtcggtagcagcaccggtgtcggtagcagtgtcagtggcagtggcaccagtgtcggtagcagtgtcagtggcaccagtgtcggtagcagtgtcagtggcaccagtgtcggtagcagtgtcagtggcaccagtgtcggtagcagtgtcagtggcaccagtgtcggtagcagtgtcagtggcaccagtgtcagtagcagtagctccagtgtcggtggcagtggcaccagtgtcggtagcagcaccggtgtcggtagcagtgtcagtggcagtggcaccagtgtcggtagcagtggcaccggtgtcggtagcagtggcaccggtgtcggtagctgtggcaccggtgtcggtagctgtgtctgtagcagtgtctgtagcagtgtctgtggcagtgtctgtagcagtgtctgtagcagcagtgtctgtagcagtgtctgtggcagcagtgtctgtagcagtgtctgtagcagtgtctgtggcagcagtgtctgtagcagtgtctgtagcagtgtcagtagcagcagtgtctgtagcagtgtctgtggcagtgtcagtagcagtgtcagtagctccagtgtcggtagcagtagctccggtatctgtggcagtagctccagtgtctgtggcatcagtggtctgagatacagactcttcagtggtcgtgacgggcagagtgctcacaatagtggtgcatgaaccagtaatggtgtctgttacacacgacgaagaagccgtagtggacattccgcatcctccaaggttgtcgaggaaaatagcagggaggttaggaatggatgacagatcgaagatcgagacacactgcagacactgaccagctgccacagcaccagccaaaagacggtcacaaatacaagtaccaccaagaatattgcagggaaggagattgttcacaattcctgtgcagattgaaatgcactgcgccaatgtaagtccgtcatcgatcggggtacaagtagtagacgaagtgtcgggctcgcaagatgtcatggttgtaaccacatcagttacagtagcagcaccggtgtcggtagcagtgtcagtggcagtagcaccagtgtcggtagcagtgtcagtggcagtggcaccagtgtcggtagcagcaccggtgtcggtagcagtgtcagtagcagtggcaccagtgtcagtagcagtggcaccagtgtcggtagcagtggcaccggtgtcggtagcagtgtctgtggcagcagtgtctgtagcagtgtctgtggcagcagtgtctgtagcagtgtctgtggcagcagtgtctgtagcagtgtctgtggcagcagtgtctgtagcagtgtcagtagcagcagtgtcagtagcagtgtcagtagcagcagtgtctgtagcagtgtctgtagcagtgtctgtggcagcagtgtctgtagcagtgtctgtggcagcagtgtctgtagcagtgtcagtagcagcagtgtctgtagcagtgtctgtagcagcagtgtctgtagcagtgtctgtagcagcagtgtctgtagcagtgtcagtagcagcagtgtctgtagcagtgtctgtggcagcagtgtctgtggcagcagtgtctgtagcagtgtcagtagcagcagtgtctgtagcagtgtctgtggcagcagtgtctgtagcagtgtcagtagcagcagtgtctgtagcagtgtctgtggcagcagtgtctgtagcagtgtcagtagcagcagtgtctgtagcagtgtcagtagcagcagtgtctgtagcagtgtcagtagcagcagtgtctgtagcagtgtctgtggcagcagtgtctgtagcagtgtctgtggcagcagtgtctgtagcagtgtctgtggcagcagtgtctgtagcagtgtctgtagcagtgtctgtagcagcagtgtctgtagcagtgtctgtggcagcagtgtctgtagcagtgtctgtagcagtgtctgtagcagcagtgtctgtagcagtgtctgtagcagcagtgtcggtagcagtgtctgtagcagcagtgtcggtagcagtgtcagtggcagaggcaccagtgtcggtgacatcagtggactgagactcagttgtagactcgtcagtggtgatgacgggcagagtgctcacaatagtggtgcatgctccagtttgagtctgtgtaacacacgatgaagaggcagttgtagccattccacagccgcccaagttgttcaagaacaatgcggggaggttaggaatggatgacaggtcgaagatagagacacactgcagacactgacccgctgctacagctccagccaaaagacggtcacaaatacaagacccgccgatgagcccacaaggaattagggtagtcaccagacttgtacaaacggaggtgcactgagcgagcgtcataccgttgtcaactggactgcatgtggaagagacagtgtctggctcgcatgaggtcatgctggtgacctgttctgaaggtgaggcggtaatggaacgacaagcaccagggagagtggtagtatcacactgagtctggggaccaacaggaatattgcaatcagcgtagtagttcagaaggttgctagccagattgggaattgcggctgtcaggtcaaatagctgggaacactgcagacaggcggcagcagttgccagcatgcctccaagtctatcacagatgcaagtggtcacaccgacacagagaccaatttgagcaatcaggtttgtgcactgagttgaacattggacgaaggtgagatcctgaggattgggaaccgaacaagtggaaacaatttgaggtgggtcacaagtcacagcagggtcaattgtggtggtttgacacacgggctggggagttgtaggctgtccacaaccggcaacaaatgtaagaagtccacttgtgatggggagaacagagacatcgaaaattgaagcacaggcgatacagtcgttaatgtttccaattgtctgcaccacccggtcgcagatgcacgactggatgcccaaacagagggcgatatcgttaataacggcggaacagattgacagacagctagcttggtcgggaacggatgggagagcacagctggtaatcgtagtctcgggggctcgccgctgcagggcaaaatgacgaggcgcggatgtgatagtcggaagaggggcgccgcaaacggggacttggggagcgaagggctcacctctcgattcaagttcgttgtagacggcgtttttgttgtccaggtggaacactgtcagacattgcagacactatgttagtacggttaagacacagggtacagcagcatgatactcactttctcaacatcggcattgtagatgagaaaatcattacaagcactcaagcaagagttctcgtttaatgtggtcgctgggatgcacgttaggggacgttgcaccggaccagctgctaccaaggcggcagcagtcagcaacaatgatagtttcatctgcgttagtctcactcgtaaagattgcaattgagggaaaagtactcacgttgttgaagaggttgtcgttcgatgggggtccagcatagacggggccggtggttatatgttctcgagggagtccttgtgtgcctcgagtttgcttgtcctcaccttcattccaaatatggccaagctaaccgttttcgtaaggaattcgaagcctgcagcgggccgcggatagtgtccttgtcattatgcacactcttttggtgatattggatgtcacacactcacgcaaacacattttctcccgccccctttctttgtgtcgagaaggcagccattctttacacgcaattgagaggacggatagagccactttgtcgctgacaggtctccattgtgactgcgggtgtcagagccgatccattgagtgctcagaggaatggttcgccgagaataaggatcataaaccgagttgccattatcatagtgttaaggtgtggcccatttgccggtcccactactccgatagctgcgtgagatgcacatgtttgtgggggacccgagactctattagttgttccatgcccaatgcgtccttgtcggggagccgtatagcgggagtcagctgcaactcaatcacaatcactcaatcacaatgacaatgtgtttgtcagccacgcattgtcactctcacatcacatcacatcacatcacacacattccagaatgggtcgcatcgcatctggttggggtggctacgccctcacggtctcgatagagcaccttctttgtcatgttgatgggaggttgcatggaccgtgtggttgtcatgtctgatatcgacagttttgacagcaaaatggtccgtaattagccaaatccgtagtctagccgtgaagcagccacaggagccaataactgagccccatgccggtcatatgactcttgtctcactgcctgcggggggatttatcggcattctggggatcgtagacttatgtttgtcggggttggtgcaggtgtgtatgggggtttgtccttcacaataggagcggtaggagaacaatgtccagaatgaaacctaatacgacccttgaaaaagactaataaacgatagtgtcctaaccgtaactctgtttttctttgatccccgccagggcccacaaactctgcagcaaactagtggcgaaatcgtgggctgacaatgggcgccctggcgacgggccatcatcagtagctcgcaggctatcgtgggacggccgcaagtggtagtgtcagcgactgagacacggccaaaaaatattacttgtctaacgggaaacgctcaggcagggatcgtcagagacatatgtccgtataactgtgcttttttttgagacatacgactcctcacgcaagatttcttggtccaccgcatgaccctgctgccttcttcggcggggccacttgtcgagattgcccatctattattccttggttccaataccctgcgcgtgctaagcacaagctgccacagtttggctcagagcttcctaaaccggccatgggtttggcgctacccaaagacactagaaccgacgtcaacccgagccgtattgctacagtgggggctcggggggctcggggggccacttgctgcttggtgcaggtgagtgacatctctcgatacggcgagcaagccagaaatctggcaccgggatgcagataacaagtagcaagctcgtacggggcacgcaacagctgcatctgtctaccttgtactcgtagcttaacttatctgatggctggtggagaataaacaaagtcaaagacgcccagagaatgccatgtctgatgcattggccaaacctactgtcccgattgtctcgaattgtttcgtcagccttggtcttgtctcgacactagctggtgcaaatacaactctcggcgacctgggccataacactgccccccccctgtactgtagggtgacatcatatattgaacgaagactttttgtattacagggttttgaaccaatttttttttatatatataccattataataaatacatgacaccttatttcttctagaagacatccataagagtgtcgggagaatcatgcccggccggaaaagccctttcgggacagtagccggccccctgtcatgccaacgcacggcaggcccactcgtacttgactccctcagtcctgatccattcgtctgtcatgttccagcccaaagccgccgcctcctgtaacgacgaataaacatgcagaggcaatgcatattcgtccgaccaaggacggtaaccaccgccgtgaacaaccggcaccgctgttctagaacgccgcccatacgactgggggaaatgttgagaaatctgcgacaacggcagacttcgactggcccttcgaaagtcggccgtgtatccctcttgcgtgcgacataggctcagcgccagcgtctcagccggaggcacctcgtcgttaccctcgcctccacgtgccaaagccttggcttgagtgccgagtaccagaccaactcggacatgaatcattgcccgcatcaggtaacagcatccaatcaggtgaggttgtttggcagcttccagcagaaaattgactctattgacaaagttaaccagtgatccccagctcttgtcctgcggcacacggcctgtcaggatatctgcacgctcttcgtagttgaaggcaatgatatagcacagcagcgagtccatagccgcggctgacgccagcgcaaactcctcagatgtgaacttggcgtctgacatgtgtttttttgcgcgcgccagatccagccaggtacgcatcttctttcgcagtagcttgaattgctgtttggtctcttcgtcgcgcgtgggagataccgcctttgactttgccttggttggagttgtgcttttgtcaagatcgcgggccgcggggattcgcgccgatgatgctgatgatcttgctgatgatgatggttcctccttttcctttctgttttccgtgcggccattggtcttgctctccctgctcccctccctggcatcgtcctccgtggctttggaaacatcgctcttgctgtcgagccgagacagcgcctttttggaaaccttgagagtgacaggaaagctcttgtccttcatctcgtgactcagacccgtcttctgggccgtcttcttgctgccaccaaactcgaaaactgcaggcaaggtgggcgacagcattttcggaaactcgacctgcacgcaatccgtccatggcggaagcgtgggactgagcatgggcggaagcgacatgttgcgattgtgcttctcgcctggggtccagctcgtttgtgagtgctgaatcgatggtcactggagagagtggtgattacgcattctgaacgctagagtttgtcactctatgcacacacacctcccacagtgggaactctccgtccgggtaacccccgcttagcctttcccctcccccacatggagtgtaaataattcaatacgaaatcacacattccataaatcaccaaccaacatgggatacagactttcggcgctgacatatgtgcagggcgacctgtttgaggagtcgccgcgaccggccgtacttgcacatgcgtgcaactgtctgggatcgtggggctccggagtggcagccggcttcaagcaaaagttccccggggcctttgtggagtacaagcgacactgcgacaaatactcggacgataactcggcgcttctgggcacctgccagctgattgagacgcacgacgcgcagaccggcgaattggtttatgtggcttgtctgtttacttctgtgcgttttggagcgcgtgtggacggccccgagcagattgtgaaacagactaaactagccatgcaggatctacagaagcagttggcgaaaatgtcaggtccaattgacggcaactcgaccgtccacatgcccaagatcaacgctgggttgttccgagtgccctggagagacacggaaaaggtgctggaggaggttggccagccctgcactgtttacgtcattgattagtgtgggcgatgaagcactcttatctacagtaggggagtgttgacattcatgtgcactcttctacagtaggggagtgttgacattcatgtgcactcttctacaatacgcgagtgtcaacattctacaggtgggcgagtaccaattgggacattctgtgactacaagtagacaactgttgagtccagtcagcgttggggttgaacatgggctacgtgtgctcgtactagggatgggtgacttgctacttatttacacctatattcgcagcgtatattaggtaattagaaaatttgattgagctgtgtccagggaaactaaatgagagcggcgaaggcagcaacgacggcgacaccggcagccagctgggtgttgaaagaagagccagcgttggcctggtcaataccgtttccgttggggatagaggggcccatggtggagttggaaggagaggacttggaaggagaggagtcgtcggagatggacgaggagtcgtcgacgatggaagaggagtcgtcgacaacggtggagtcgtcggagtcgtcgacgacctgcttgtcggtggtgtcgttgacgatatcatcgttggagtcgtcctcaacgttggagtcgtcctcgacattggagtcgtcctcgacattggagtcatcctcgacgttggaatcgtcctcgacattggaatcttcctgagaatcaccggtcgcctcgggcttggcatcgccagtggcagtgggagcggcatcgtcctcggcggcaaagttgggggcgtttccggcaagaccaaggtcctgggcaagagcctgaactcgcatggtggctcggctccactgctcggggatcttgggagtcagctggggcaggttgggggtgacgattgccataactcgacccaggttgttctcgacgttggccatggccttgggaacatcgtagtggggcagggcagagtgcagaccgttggagaccttggcgtagtcgggagagccctcaaaggcagccagggactggccggcggcagacagaagctcgggcaggttgtcgtcgttcaggccggccatggcaacgggcatggccttggagaagagaccgatcatgtcggggttcttggtgacaacctccagaacggcctggagctcggaggtggcctgctcgggagacacggagtcgtccgtcttggcggcagcaatgccgtcgacaatctggttagccagagaggccacaatggggttctgggcggcaacaagagaggccagaatggcaaaagtggcggaggtggagagagaaaccattgttaatgtgttagaaacggcagtgtttgaagtccatggagcccgccaccaagctatatataccagggattgggtacagtatcactactcctccgggtggcaggggtcaggggtgcctggcttcaggcaactgctgtagtttcggggccatactgttctcactggtctagttacggttgccatagaactgaatcggcaacaaagtccctcgtaatatggcataatcacatgacctatctagggtagaaaagcggcatatcgtatcgtatggtacaactgagtactgagtacatttttcttgcaccgcacctactactgctcatcatctcagtacagtagtctatgacgttcttgcgttccattagcatataaaaaataaaaaaggtttgttacaagtatcgtatagtgcatactacatagtgtacactgtacgtatggaaggggttgaaggaaggctgaacagggtgtttctagggtttctattaatagccatgcattaaatggcccaatttgccgggttatttgctcctttccacctcttctttcctgttcagctgctatgaaacaccccatatgctccccttgctatacatgtcttgcgggtctaaatttgggtgcatatgttgaaagtcgaaagggacgagagagaaagagtagctggagtgggaccgaaattggactagaaactcgtttcgttgttgcagagtacgtgtacttgtacttgtacactacttttttttactcgtactgtacataaaccgacagtctagcacacatccctcttgcattatctccaggtaactccgaccatcccaattcgtccaagccctgcagggtcttgctccgtgacagaaggtgtaacggtcgaatgagtggcggaagggtgtcgtattaggtgtgagactaggcggacggaagggtgttattagtgggtgttattagtgggtgttattagtggttgttgttgagtgactggagcgtgttggtctctatgaacaagacttgaagcccaggatggtgaacgccgcgagtcgatcgacggatgaccaggagcaatttacatacatacaaacccattgattctgtttcgaagccttgagccagtaatctgttggccatcagcactcccgtgctgtactatagtggtcgctcaaaccaccccggccaaacggaccctcaggtagtcgatgaggtccgtgacaagtcctcccggccaagctggtttaaggctcgagaaatgttggagctgtttatgtccctcttcgccgtctccataataaaagttcgagatacagactgtcagacagttagacagtcaggcagtcagattgtcagattgtcagattgtcagactgtcagactgtcagattgtcagactgccagattgtcagagattatctttctgacagactctttcccgcagactccccgacagactccgacagactccgaaagaaaccgacagactcttcccgaggtcacggacagtcgtagatgtaggtttatattctgtctgacttttcatcacaactgtttatgagtgaagtgagtaatcatccatccacgtacattcgtctactgtacgtacattggtctactcgctcttctgatggcgttcggagaaacggagactcgtgactgctgctgtacgcgctccagtctgacacaattacaccgataatcgctcaggtcgttgtcactcgccgagctcttgtttccgtgttctgccgggtaaccgtcggaaaccgagccgacggtgttgtgacataaaactaggttcgtccgtcgggcggacctgaggaaacaggaacacacgcggcaaggacgagtctcaagcggtgaagaaatgtgcgaccagcaaagatggggcaaaacgaggcgaaaacgaggtgaaaacgagcgaaaacgaggtgaaaacgagcgaaaacgaggcaacaagtgagatgaagaagaggcaaaaagaggcaaaaaaagacaacaagaatgatgaacaagagccaacaagaatgatgaaaaaaaggcaacaagaatgatgaaaaaaaggcaacaagaatgatgaacaagagccaacaagaatgataaagaggcaaaaacagacaagagaagagggacttgatcaacgaacgaggtgaatttgattgaaaagcaacgtacactcacgtacgacactcacgtacggcttgtgccggttgttttctcacaagacacccactcgcactactgtagctacaatctgcaccaacaagcaatatccattcgcttatgcgtgattggtgcagataggccgtttcgccgacctggggtaggatactagtctagagataaccaaatatgaagatgaaaaaccaccaacacagattacgagcgtttttaccgtgaaacagacatgtcgtggacttatggcttcgcttgggacaccctcagacggctgtttctccgccgcccatctcccatctcgtcctgtttcaaggttgcaagcgtgcattatcagctgaaatgaagcggccaaactctaagctcaggacgcaggttgatccgcggcagagaccgggccaatcttgtaggcccgataaacaccccacgcgattagagccaggcagctaagatataaaggtgagccatcccgcaactagacccctcctccaaacgacaccagtcacgacactgacaccaagcgcagtcgcaacccttacacaaacgacgacatgacagcagacactctcacggcaattcctctgcccgacgctcctctgggagccaccatccagctgcccaccggcatcaccgatccggcggatctgaacgacgccgacttccagaagctcaaggaggcgctcatgacatactccgtggtggtgatccccgaccaggccaagctcaagccatcgtcgcagtacgccatcaccaagcgaatggatccttcctgcggagagggagcatacggccactccaaggagttccgacacaagcagtccgtgctggccaaggacggtcattcagtgccccaccagccccaggtccagattctcggccagggaacccactacaaccacgagggcgtcgaccagctgaccctcacccaccccatccacgacaccttccacaagaacgtgctcaccgacgaagaaaaggcccagggatacacccggttctaccgatggcacattgactcggcactgtacggactttccccccctgtctgcaccactctgctcggaatcgacgtgcccccttcctccaagcaccagaaggtcaagtacaccgacaccggcgacgagctcgagctgacccaggccgccacctgctttgtgtctggcgccaatgcattcaagctgctgtcgccagaggaccagaagctggctttggaatctaccgtcgtctacgctccccacccttacatcttcatctcgcctgccaaggctactgatgatggtctgactatggtcagcgagggcaaggagatggatctcgaaaagctgcccgaatgggaggaaagcaaggtcaagcgactgcccatggtctggaccaaccccgtcaccggcgagcatcatctgcaggcccacggctgttgtgtccacaagattgagcgaaagaacggcgaggttttgcagctcgaggacgctcgaaaggagttgtatcgaatcatgcgacccaacattgatcccaagtacgtctatgcccactcgtggaaggccggcgatctggtgctgttccacaaccagggtgtttggcactccgtcaccggtcagtttgctcctgacgagaagcgactcatgcaccagtgcaacattgcttctggagttgatcccgtgtgcaacgcctaatttatgagattgatttatgtattcatgtaataatttattcgtgttaagatgataatgggtacaggcaaaagtacatactgtactcgcgtagaaaatctgttccaaataacccgttttttatgggtctttcttcgaccatctatagtacttgggacggacagaagtcttcgtccagcttatcgtgttgacggggtctcatgtccacttggtgttggtgttggtgttggtgttggtgttgatttggtcagaaagtttcactacaacactcagcgacccgtgtttgtagaaaccaccaacggcacgtacaagtacgatgattaaataatgcattctatgttaatgttgcggtagctgctaccatgggacaattaggactgttcagtggacgcagacgcagacgccgacgccggagcagaagcatctgttgtcgatgcagacgccgaagcagaagcctctgcggatgcaggctcagtagaagcggaattggacatgtctggaggctgaggagtttccgagtccagcttctgcttctttgcgtcgccctctccctgctccttaagcttgcgtttcagcaatctcgccttggttttctccacgtcacacgaccgcagcttctttccaatctcctgcacatactccttggtcggcttgtccaccttttgcagcatgtcaacgcactcctgaaccagctttgtggtcaggttgaactgcgctgggtcgctcatcttcactcgcaaatactgctcggttatctggctatttgtgcacatcatggccgcgagcgagatttgcggaggggtaaagaggaaatttgcgtcggttagaaagctcagagacacgtactttctggctccatcgtacagagacccgactgtcgaggcaggaacgtggggcagcgacgtctggatgtcgagatagaagccatgcaagggagtgtatgcgctctgggcgctcaaagaaaacagcatcgactgcatcaccacaaactcgagttgcaaaacgtccttggccaccgctccagtgtatttgcagaactggttgatggaaaagaagtgattctcggctttggtggccaaaaagaaacacgtatgcaagaccttgacggggtcactgtacaccatgacggagttgatgaggaaaaactttttgaagaagagtacagctgttgccttcactttagaaggtagattgagaacttgggcaattccctcgctctgagaacacatgtaattgaccatggtaagttcctcgtcaacagagaggattttggccatggcgggatcgagatccgccgctagaaacgactgtttgacaaactcgcggccgttggtgttggtttgaagccgtctagctgccagttgcgtcggcgtaaacgaccattttttgaactgcgacgattgccggtaaatatcgtcgtccgtgaccgtttttgtggccttggatgatgctgtagcgcttgtcattgaatgagtattgtagtgtattgaggctgcttagttctgtttcgaatcttgattcagaattatgtaagctgcgatgggaaggcttgaccggggttagggttggtttcattctaaaaattaaaaaaataattttagacggtgagactttaaacacgtgatctgtatacagctcaagtagtacatacgggtagtagcgctagttgcagctgtacacctttgaagaaaaacggcgggattgttgataagcttagtaagcaaaacgagccgagtccgttgggtcctccggtcgcttattaatccaagggagtggagtgtgcacagccttgggcaggttagggctacatgcatgagttgcgtggctttaacgattatgtactcgcactgtactaaagaggttgggggcagagatgaggtgtcacgtgtgtgggggtgtagttgtggtttgttttgtgtaacttgagaccggtcgccaaaaagtatttaatctctctgtttcccgcggttttctgctacccttatcgcttgatggcttgtgctctggtgcatcactttgttgagccaattcactcacgctgtatagctactcccacacacctcccaccacataagctcacaaccattgctgtgcgcatctgacaagtcatcaacatagctctggcccagcatcgcgacatcgacaatgccgtctctgttccacggcgtgtaccaagcgctctacgactatgaggctcgtacggaggacgaattgaccttttccgagaactcgcttctctaccttttggaaaagtcgtcgaccgacgagtggttaaaggccaaaaaagctggacctgcgggcaccaacgaaatcggactggttcccttgacttacattgagccggcgccggccaaacgacaagcctatgctctttacgactacgacaaacagacagaggaggagctgaccttcaaggagggagacgcactgacagtctacgatgacagtgacagtgaatggttgctggtgtgccgcggaggagacgagtacggatttgtgcctgcaaactacaccggcgacgctccgccatccgcggcccctgcccccgtggctgctattcccacgcctgttgccgccattcccacccccgctggccaaccgacgacgcccatcaccaaagactcaccactacctcctcttccaaaggatgccttccccccgcccccacaagcgtaccgaccgcctgcctcgaccacccatgcgtccaccgagcccgtctacgccaacggacgggacgaagagtctccccctcccatgcctgcccgaccaggcggaagcggaaatggaagtggacggccctcttcgggagcaggcgacagccgaagccgaggctcgtccgtgtctcgatctcgaaacgcttcctctgcaaatgacaagccttcctcgtcttctgccaacttcttcacatggcctgtccaggaggtggacggacggaaaaaacgaaaagcgactctggcgattggcaacggcatgatcatgttctccccggagcgatcgtccggacagccccaacaatggccagtcaaggatctcgttaactacaacagcgagaagaaacatgtgtttctagactttaagcaccccaccgtctcgtttgatctgcacctgggaagcaaagataccgctgacgaggtgatctacgcccttggcgaactcgcaggagcctacaactcttcgggactcaccgaggtaatgatggcagccaactcggccggccagaagctcggaaaggtgctgtacaagtttgacgctcagggtcgagacgaggtgtctgtggaggagggcgagaatgtgttcattatagatgacacaaagagccgggactggtggatggtgaaaaactcgtctggagtcgctggtgtcgtccccagtagctacattgagattgcgcccagcgaaaagaccctcaaaaaggtagttgaccagcagaggaaggccagcggctcgtcgcgtgataaatcacgtgaccgatcccgtgacgaccggtctcgagatcgagcggacaagcgatcgtctcgatcttccagagacgctcccaagtccaagcctgatcctagaaaggtgcgaacttggaccgatcggtccggtgcattcaaggtagacgccgctctgcttggatgtgtggacggcaagatccatctgcacaaggtcaacggtgtcaaaattgccgtggcctgctccaaaatggccattgaggacttggagtatgtggaggacgtgacgggcgttgatctggaggaggacaagcccctttctcgagatcggggcggatcttcgcgagaccgacgacggtccacctctcggtccgaccggcgaaagtcgtcatcgggagctgcgtcttctgcaaacgctcccaagccaactcccgagtcggactacgactggttcggattctttttggattgtggagtcgacgtgcatgcctgtcagcgatatgccacctcgttcacacgagatcagatggacgagtcgattctgcctgaagtgactccctccactctgcgatctctgggtcttaaggaaggtgatattctgcgagtcaccaaaaagcttgacgaaaagtacggtcgaagcggcactggtacttctgccagcactcctgtgggcggcaacccctccggtggcctgttctcagacaccactggtgctctgaagaacaacaccagcaagactcttaccaaggcagacgataccgatccctggtcgtctctggataagcagcaggctcctccccagcaacaggcgcccccagttcagcagcagccccccgttcagcagcagcctatccaggctcagcccacagctcctattcagcagcagcccattcaagctcagcctactgctcccatccagcctgttcgaaccggctccatcaacgatctgatgaacatcaagcccctgcagcccaccccgacatcttccaacctgcagacacaagctactggtggtatcatgcagcccatccagcagcagtacacccagcagccaatgtcccagtccacgagtgctctccctcagcagagcatgaacaccggcattcttccccagaccactgggccactacaacagtctcttaccggatctgctcccgtgcagaatcctttcctaactggtggtcccaacactcttctcagtcagcagactggtgggctggttggtgtccccaccggcggtcttgttggtgtccccacaggtggacttcagggcgttcctaccggttacactgctcagaatgttcttggcatgaaccagcctgcaaacacgggcgggtactccatgaatgccatcaccaacgctcttgccggtgcttccctcaacaagcagcagcagcagcagcagcccatggtccagcaacttaccggaggcagcatgtttggccaacagcccatgcagcagcagctgacgggctccagcattttccagcagcagcccatgcaacagcagttcacccagcaacaaccaatgcaacagcagttcactcaacagcagccaatgtcgcagcagctcactggtggcagcattttcaattctcagccgcagcagccttttcagcagcagcctatgcaacctcagcagacttccttccagcagcagcagcccttttccactggagcttctgcttcgccgtttggaagccagcctactactcctttcggacagccccagcagtctgccggtttgagctactttaacaacatccagcctctgcagcagcagcaggcgtttggtcaacagatgcagccgcagcagaccttccagccgcagcagcctttccagcagcctttccagcagcctttccagcaacagcagcaacagcctttccaacagcagcaacaacagcctttccagcagcagcagcagccgtttggtggcctgcagtcgcagcctaccggctttggttttggaaacagctcgtcaccctttggaggcatgcagtctcaacagaccggagcaccttccacttcttttggtcagcagccgctacagcccaccgccacgggtcgtcagcgagccaacctggcctctgccactcctaacaatccctttggtttttgagaggctatgtatgaataatgttatgataatgtaattggcgacttgtatgtgaatggacgagctaattgaaaatgtgtaacaggtattttgataaccagaatgtataatctcatgtgacttacagttgctgccatcaagattaaatagattaataaatgatttgtaacagcaacaacaataatgggcatttttactcctctaatctccaaaccgaggtgtagttgcagcagtcaaaattacggtttggaaacaacattaaggttttattgtctaacagaaactgcattttgaaactttggggtcacgtgacccgtgagtcatgttgaaacctccattgcgatgtagccaacccatcacggagcggcatggcgcagcggaagcgcgcagggctcataaccctgatgtccctggatcgaaaccaggtgccgctatgttttttttgcttatggggggaatcttgtggttagcgtgctgggtgtggcagtacgtcaagtacatccagtaatgtcagtgtgattcacgagtagccattgctgtgttataaatcgactttcggaaaacctgtgtagaccaaagataggcggagaggtgtactagggatgattggagtccaacttcaggatgtattataccttgcaaccgtggctcaataaacagtagctgatgagtatacatgttggcgaacgtcggagaactcgccttggccagaggacctgggccctgtaagatttctacttgtagtgcaaggctgtcagttgacccaattatcctcaaaggtagtctgcaattcgtcatctcagactgtcaaaggtcaacaggttacgattcctgcgagtattggttcgtccatcggtcaatagtagtcactttgacagtatgttttgtactgtaactgatggtcgagttgtaagcgccaacctcagactctttagttgagggctacaagtagttggagagaaagttgttctgcgaaagttgaaagagctcatgtaaagaagtgcttgataaaatgtacacttgggcctttcgagtaacgtgacggccgaaacggtacactttctgtttcactattcagagttattttcggttttgaagttgtttgatgcattgaagttatgcattgttaacttgtttttagttagatattagttagatattagtgatgtattaggaaaacataagtagcctcaacagcatttcaaacaagtattatgtgcatggatgtactgtacagacagtatgtacactgtagtaagccttcagcctacagggacagtggtaaatgtgatggataactgacagaaattggccattcatttcgtcttccacccactatcggaactccatcttctctacagtcgcgatttcagtctcagcaatacatcaccacatgcgtcaaaataaactcttgcagagacaaaatcacaacatctggtatcctcaccatcacatccaacaatgtcggatttcacacaaaaggtggagaagaagtttggtgagctcgtgatcgagcactacttcaagagcgagccgtttgtgtactcgtctccgctcttcaacacgattggcgacacgcgaaagctgtttccggaccgaaaaaacatgtttgatcgactctacgaagacaacatcaaccgggaatcgctagccgagacgcaaaagctgtttcctccttcgaattacaacgacctcgtcaaacttgtgcggcggatcgagaccgacaagaccacagaaacgctccaggatgacctgcaacaaaactgtctaatctactatctgcttctggacgccaaccaggaggcagctgacgcctacgcgaccgagattctgctgcctgtggcttacaagcatttcatgaacggctgctacgccctggatcgagccgacatgaacacagctgtggaggaaatcacctatccaggaacagcttccacttaccctgacgcggttgtgcgggctctcaacgctcaggccgttgcccagaagaagcgccgcgagggcgaccagctcattgtgcggtactttgacgagaccacaccgaaatgtgaccagcgagagtccgtgaccatctacatcgcctgcctggcgcgtctggaccccatgatggctcttacatacatccgatctctcacggccagcgcgcaaatgggcgcctttgagtgtctcgtcaaagcatgcattgaagaacggtacctggggggcgtgtggcgtctgagtaatcttccctttactgaccgcgagggagatttgctgcaacaggctctggacgctgtcagcactgacgaggatctcaacaacgacattctggttacccgggctctgcatctgggccaggttcgaaaagcaaagagtctcattaacctggccgtggcgaaacgaggaggagaggaaaagtggggcgagtacgaggccacgttggcgctgtactagacgcagcatcagcggtctagatgtacaataaattattcagttgtgtggatagtagctctggtatttgatgccagtatcgtaggttcaacaaaacacgtggtagaggtgatgggcgagcagcgtcagtacaatacgacgatacgacgatctgaagatatgacgatatgacgaagtgactgtcacatagtcactggcgagattctgtcgagaccaagtgtctttgtctgcttctgactctgctgtaattttcagaatgcattgttgcatgatgcgatccaacgaacaatgaaatccgacactgtcttcttcttcatcaccagtggtacaaacacctaccacgacacagacacgaagcaataatggactgtcttaatgatacaccgacactgttacaagtctcagcccttcgatcccaacacttgccatgacactctcggagttaagccaactttatggctgagcagccgtccttcacagctaggtcaaactgacattacaagtagtcaattgacccactacaagtacgcaccgtttggtcaccatcggggctgattcattggctacaatgcgcactatcgctgtggtacctagactgcctgctacaatctcctcctcctacaggaatgtgtctcaggagtgtccggaggtttggctggcactcaaactcctcgctcaactgggaagccgtcagactcatcgcgctccactaacgtcaatcgatccatactatatacatacatctccgtttactcgacggaagcatcgagcttggctcccagagaggcgagcagagactcgggggttcgggcagagatcatctgcaggacgagctccagaatgggctgcttgacggactgctcgtagattcccagaaggtcggtgggcacggggtagacggacagagccttgtagtaggcaatggcggcgttctcgatgtcgttggcctgggcaaactcgtcggcctgggtcacctgggccaggaaaaactcctccttctccttcatgccggaggggatctgctgggatgccaacgaggcgtcgagcttcttgatgatctgctgcttgatttcgttcttcttggcggtggcatgggcagcttcagccttctccagatctcggttgctcttcttgagctttcgtcggaagtcggcgttgtgtcgtcgctggtagtcaaagtagacaacgtacgacagggcgcccacggccagggcggaggtcacaacggtggcggtggaaggcattttggggggtgatggaggatgtaaggttgttcaaggtgatgttgcttcctttcctgcgctgtattttcgaggaagtgaaaattcaaaccgaaccgggtctaaataacgttagggttgtcccactcgcagaagcgtgtagaagggtggaggcagagcggtggacagaaaaggcccagatagaggagcatcctggcgcatttcggcggtggcttctctggtcgattttcccccgatttttgtcatttttttccccaattttccacttttctcctgcgcggtttattgcctgagccaaaaaggcggtgtatttccggcaataccgaaccttacgagttgggaagagtagcgaactaagtaaagagattaaagttattgggattttgttaagaggaagagtctggaggagtgagaggcggtgcagattcacaacagcgtaaacaggcagccattgcagttgaaaagcgattttttttttattttccgccacagccatacaaaaaggcgagttcaatgcttgttcaataccgatggcgcacgtagctcacttggtcgtcagtagtctgatgatgccccagaagctgtacatacaagctgtacatacagtgtgacaggttgttgcagtgtagccgtgttgagacgtgatcaacgcgagatcaaatactcatagggttatggctctgtgtgaactacagtaagcaccgtccaggttcgttattcaataagatagcgtcgggtaattggtacggtgtgtacttgtagctggtaaatgtactgtatcttcttgttgctgtaccttcttgttgctgtatcttcttgttgctgtaccttcttgttgctgtatcttcttgttgctgttctttcttgtcgctgttcttttttgtcgctgttcttttttgtctccgttcttccacatcgccgtatctttctatccgtatcatccatatcgcctatcacccccttccctatcctctcaaagattcaaacctgttctcccaatttacaatctatcacgctctgctttcctgctcactctttccctatcctcggcgttccgagtctcaacccagctgcagtccctcttctgttgcaagtctcagttgcctggcatttttttgctggggttcttttcatacacggccttgatgtagtccatcagcattgcggcctttttgagctagtactggcgagcggtctttaccccaggtagaggagaatttcggtgataccaggacctgtattcctcggcagttcggtagttgagaaacatgtcagaaaacgacttccagattccaatttggaaacggtagcgttcaggacaaagattggcgtagctcacaatcacctccctctcctccgcggtgtagggcatctctggggtgttgattggcttttcaacgggccgtgtgttgaagtaggtattgctgatggaggttcgtggactctagcttgattttccgtgactctagcttgattttcgactcccttgatcttcgacgtatagtggcctcgcttctttgctggaattcaaccagcctggaatattcggttgaatagaagctggggattggggcgggatggggacacgtgcgacgaatccgggaacatttccactcgagtctttgttaactcgtcgcactgtttgtcggacagcaggagatcctctcccagaggctcaggcaactcttcttccccatcagcgagtgagtcgggctcaccaggcggacagacgaaaaaactggggcggattgattctatcggcaaatgattctatcgacaaaggactgaggctggtcaattcgatcagcaaatgacatggccttgactgacgattccatgacccttccaaacctgacagccaacggaatgtgtttctggactttcgccatgagccggatcccgcccttgtaagttgctctgttgctctgtggtgtggctatcaaagttgtggtaagatagtgcatgagcctgcgttcggagatatcggagatatatatcgggatgaggacgtcaatggttcatgacctgaaggaaaggacgggactctgtgagtttgaacaagtctttgggaatgttcagttgagagcctggatggggacattggaactgtcacgagtgaaagggactagtgagggtgtagatctacctgggcgggaatgacaagacattcaatgggtttccagaatgagttcccgttgacaagaatgggtatacgcgacaaaaaaagcattggtacaagcatttgtagtctatcaaccatctaactcgcaacattaatcttccattgaacttgctctagaccctttttgcctcgtccaactattcccgcacaaccctgaagcgtagcacaactgtcccggagagcaagcaacgtccaatggttccttacacatggagcacagtacttacagtacctaagcccaaaccggatactcaattgaatgtctaagaccacaaaggactgtctcactcatgaaataacgtcagccacacggcttccccggattcttccagcagtatgtacagtaagtcagtatgcacagtaggaagcaggcaactttgcgaggagtgaccctacaagaatgaaaattgctgcatttcaattggcatgactgttagtacttgtacaagtacaagacttggctataaacaacttccttccctggatggggccaagttatctctttccatgacatcttctttaggagctagaacagtttgctacgaacctgctacgaacctgctacaaacctgctacgaacctgctgcgaacctgctacgaacctgctacgaacctgctactaaaaccgtcaaaaaagttctttaagaaccagattttttattaaacatttgtcaacacctgaaaagttctattaacgccacttttgtcttttccatggcgtttttcggcctccagctcaccacccgtccattacgtcataagcgtaaccgcagcaacgtgggtcaacattgaaaatatttgaagaggcccaaacactccgacactccaccaacagaggcggaaaaacttgctacagaaacagcagaaaagccgaaacttcaaaatcgaacgttgacactgttaataaccaccacaagcaactactttagtatctgctctccccacttcaccactagccctggctaccattcaagtacaatataccccacaatttctttgaacaattgcccctgaagtttaggttcagtggattaacggctagaagaagggtcacgtgagcctcggacgtgctagagactactttggagacgctaagaggcaccggaaacggcctcttcatctcttgttagtccgtctttgcaccttggacagccggttgcactcgttctctgacactcggtttttaggttccacaacatgcacgaaacgcactccttgtatctgcatcttcaactacagtgcatacaagtacagttgcgatatcagaccgacatccgagctctccagccatggccgaaacgaccccgctactaggtcgcgacgatctcggtgacgcgacggcgtctcagccgctcgaccttgtgcccatctactcgttggtgttgtgggttcacgacattatcaccgaccgggtcgaaacgtctctcaagtatgagcagattaaaacaccccaaatttacgcctatctgatcaagccgattgtggaggagtgtatggtgacggttggtccctgcgaggaggaaaaccgagccgaaacgcacccagactcgtgcgatcacgacgaaaccatctcggttggtatcatctactccctgctcgcaaaccaagtccagttcctgagagagagtgacacagatggaggagtccacggaggcgtactggagacacgcgccattgtgtgtgagattgtggctctcaaactgctgcgtgaactgcacgaagacgatctcatccaggctctcacttacgacttctacccactggccacaggcaagccattcaacgtgattccgcggtaccagcgcattagtgccctcgaaatggccatcaaggcaggcgcaaaacactttctggcccacagaatcgtggttgcggtcgtccaggagatctgggacggatctatcatgtttcaaagcagcatggacaagctgcacagaaggaaaaagcctgacaatgtgttcacccaagagctggttggatacggacgaaggggtccaggcgtcaaatactgttatgaggacgcgtcgctgttcaaactgtcacgactcagagtacccagatacagacacagtattggcatagtcacttttgcggtgctcatcgtcctgtatctaggagtactatatcagcaacacaagcaactgggcactctagaagtagtcttttggttgtggtcattggggtttgtgctggaggaaatcatcaacttcacagatgcgggatacaccctctacgttatttcgatctggaacatcatcgacctcatcattctggtgtttctcgtatcgtactttgtggtgcgagtctatgcgctcgctgtggcgtctccagacgcattttattactggaatgcccgagcctttgacctacttgccaccgtcgccatcttcctcttccctcgcatgttttctgttctcgacaactatcagtacttttcgctcatgctgattgccgtcagaaagatgaccattgatctcgtggtctcgtctgtaatgatcatcctcttttcggcagggttttgggtcgccttcaccatggcgtttgcacgagacgtgttttcagccaagaagattgcatacgacctgatgaagattctgtttggcttcacacccaccgtatgggattcctggaagtactactcggtcctgggccgtgtcaatctcatgttcttcctattcgtgacacatttcgtgataatcactatcctggtggctgttctgtccaacacctttgcagccgtatctaccaatgcttacgaagaggtcaagtttttgtttgcggttaacaccatcactatgatcaagtctgaatcgtcgtctttgttctcctacgctccccctctcaacctgctggagtgggtggtcagaccactgtactacgttctgcctctgcgccagtttcttgtgctgaaccggaccatcatcaaaatcacgcatgcgccgatcctgtggaccatcttcttctacgagtgcttgcatctgcgcctctcaggggagaaggctctcagaagacggcagaatgagattatcaagcacgagatcatcaaggggcagaactttagaaagaagggcgccttgaactcgtccacggcgccatccaccaacgccagctctactgctaatctcaacacacagcccagccatgatctgagagctgtggttcccaacccaaataagatcagaccaaagcggtcattattcaacaagatggcccacaagctgcgcaagccgtccaagccggaaatcaaggtgtccaacgacgatctgctggacgaagtgttcaagcggccatataagggcactgtccgcatcaaaaacaacacaggaacggtccagatggaaaccctgtttgatggacaggatgacgaggaggaagagaacgccgtggatggagaaattccgttggagagaaccacttctcgtgtcacttatgagtctggaagacggactcacagtatgacttccagctccagatggatccctactcgcattactggaaatagaaacacttcgggaagcacgtctggaagcacgattttgccccgaaacagactggcctctgccaattcgtctctcatgcaacaaaatctcgccatcagtccctccagaacagtcaacacggctctctatcattacgacagcgacatccggtcccaggcactcaagtaccagaaacgacagcagctattggacaagctgaagcgcaagacctcgattgacgacgtgtctcttggcagtttggatgatgacgaggaggaagagcatgctgacgacgatgatgacgagaacgacgatatcttgtcggacgcccagccggacggagagcttttggacatgaccgccatgttggtgggccgaatggatgatctccaggagagcattcagaagattgagctgttgcttggtcatttcatggagaggtgagatagtactaaagaggagaagcggtcaagagaaaatgacgccagagagaagtggagatgaaaacgaaaacgaaaacaacagtttacaacattgggtaatataggtaatggtaatgatttagtataatgggtttgaaggagaggtttagaaaactcatcaagagaataacggctagtctggatgtgaagggactttacatactacttgtagaaccaatattagcttataatggtggatttttccagtctgtttactcgttacaggcactgtagttgttgtagttgatgggatagtgattcacaaaggtagttgtcatttacttaagagttaacaaatatctattcaactattcaagtaaagtttaagacgtagttaatatattcttaactttagaagagatcaaagtgaaaatataagtacctttactgctgtggaatcagtataataagcacacagtgaagcctgaaacttgattttcaacacactgtggccttcatttatccatctatactccatttactgcgtttaagatcatatttatatgtcatatactcacccatcacagctaccctgtaaggtcttctacaacataagtaccccccccccccccaccaatcccacttcacccactcctctgcaatcgtgtccagtcgacccacgactcactcaaaccagtctcgggagaaaagacgcaacgaagagacgtttgaaacagactatggtaccatctccggctctggtctccgagaatgactctgatacgaccgacttccaggccaaaattgcacgccttgacaaccctgaccaagtggagaggcggaaggaggaggaatggtccgagaagcagcggatatgactcgagactgggtggtatagttgtcgatcttgggctcggacatctcggtgagccgtctagacctggagaaagcgttgaatcgtccttaacagacttgggagtcgcatcatctaatcgccgtcgtctccaccaatgataatggggggcttcttgaagggagtaggtgcagaagaagacttggagggcttctggaaggcatttatttctgtcattgagagacataggctcgccgtcctcgtccccgttctggtggctctcatgaggtccgtcttgatggggttgttttcagagaactccttgtgtccgttgccctgactcgaatggctgcaatgtcaatcttacctagggacttgtaggagtcaccgacattgcctcgatctgagtttgcgtctcgtccctcgagtgtgaaggtcaagcatcccggcttctttcggatctcggccaggtcacccttgacgagcttgtaggacgactcgacaggtgtggcggaatgtcgaggatgattttttttcttaggtctctgtgattggtgggacgagtacgggaccagttgccttgatagtagtcctctatgcatgcccagagcgggaatcagttgccacaccgttgccccaccagtgtggatgcggggtaattgtagtgcatgaatgaggctgtctcgagatttcaccagggagagcagcgtatagcctgcctcgtcttacacaatcgcagcatctctgaaacaagccccattcattctgccatttatcttgcagttctcggaacttgatttgaggatgatgcatgaacctcaccaactgactgcctcattggtttcaggtgggtttggttgcaggtattaggagatgtatatatagagagagagctgttcaatgtttcttgattctctcactgctaccacctaactacgatccaactaaaacccaactaaaacctcaactaccacttccatacaatcaatggtcaccaacaaccgggatatcgacaacatgagtttttctcagctgaatcacttggttcgtgcaatgagaaagcgcgaaaaccagctttcccgagtgacctcgcagtttttcgactctgtcaaccagcatctggagaagatgctccgtgacacgaactctcctacttccagacaagagtgttccgaggcggctcggactttgaagcggaatttcgccctgatgcttgtcctgtggaaagaagaccgaaccaatctggttcaactgctgacagaatgtgtttctacgctcgcaaaaacgatgcagcgactggctcaactccccaatgattccggaaaggtgcttagtcgaaacgccaaatccatcatcacaagagccgaaaagacattaaattcgatcactgaacgtttcgaaaatatggagaaaacgacactatcgacactattgcgcaagttcgttgtacgccagaacccggagttgaaaaagtggtttcgccaggaacacctcagccgtcgccgcaatatccgacctatcgtggctttggcccaagagagattttggccaaaggagtcattctatacgcctcccgagctcatggtactgttttacatcaatgcagatatcctggcatgtgtaaagtccagtcgcatcaactctgactggctccgttgctttcaggacccgcacatggaaaaacactgggaggcgaagatgcgggctcagaatccaacttttcggctaggggatgcggatacccagacttgggctgactgtatcttggcttatgcaggccgactcgaaacctggcaagctgttgattatgtgagtggcaacactacaaacaagacccctgctgagggagactcccacaatctccaatcagacgtctttcaactggaacctcgacattttgtacctctcaaggactcatgggagtacttttgctaccatcaagatgttccgatgttccatagtggcggtccgctcacgccttctgagcttctccaagtcttgtatctggacaacggtgctgcattcattaaatatgggggcattgaattcacgcttcctcccagcattcttccggatgaaatgcttggctatgtcgaagatcataattattcgctactttctgtcaagctgactgaccgcacaatccaagttcggttgaagaacggacaagttgtcttattttcccgcgacgacccccattcccagaaattcttcttgggagcagttggagaagactactttgaagtcggagatgctctttttgcgagggcaaaacaaggcacgggttggacttactccatttttgaaatcggcaatcaggagactgtcagggtgttcgccggaagctcgaagttctcaactcctgtgacttgtggaaatggcatcatttggtggaggatcgatcgacatctcgtccctgcgttttatgaccagagtggttcgggaacagtgtatgtaccaccaagcactatcaaactggaacaacaaccggagccagtgagtgccgatccccaacattctacaaagcaagtgggcagccaactggctgggtcgtcgtgggaatgggtgtccctcgccgtaaaccacaacgctacccgcttgggattggtcatgtctgctgctgcaggatttatggcaatagtacgttgactatcgtgaataacaattatgtaaacatcaatactgaatcccgtatcctttagattcattctatggcgttcctgctctccttcatcctggatcttgagttataagatgcaatatatcataacagaaggtacttatctcgtataggtctggtagcagtgttgactctctcaacctcttacagtctaccatagcagacgaccactcctaaacaatcattacgagaagattaacaaccctagccactccaatattcccctcaaagacagatggaccttgggcgaggctctgttttgcacaagaagagctccatcaactatttcgacaatggcaacgcattattgatgacaaagaatggaccaagaaccacattttggagtcatttagtccaaacagatgacctctgactactactactacagcagcagctaactagcaagtcctcaagtgactcggaggacatcaagtgagtcaggagggtattggtgtcctatacctttcgccaagttcgcagttttctcatcctgtggatgcagctctttctccgagcctgagaaggtcagtcaacctgctggagtggactcttccgcatgtggaagacgagatctggccacatcggttcctcaaggtcatccatcaagctaggaccgaccgggatttccagcaaaatgactccacatactcaagaacatggacagattgtagaaagtattggcatctggaatatgacggatctgaaacgcactgtctatactcatcggcacgacgggacctagctgcgtgaaaacatcttcagaccctcgtgtgccagttcaacaagtcctctaacccgaccatgagtacttaaacgccagttccacaataaatcacccgctggagaagattgactgtgatatttccctgatgtttgccaaaattgtagttattcgaaacactttccaaccgaaacgtccggggaaaacgcttggaaagggtggttgggtcgctcgagtatacatccatggcgagtacctcttccagtttgaccataccagttacagtatgactgcttcgcatcgtactcgactattctaatacttccgtctatcttactggcctcccagcccagcaaccatggtaagagaccaggcgagagaagtgcctggatccagccatcgagactggaaaccccgggtgaaaaactgatacgcagcattggggtcgaagatacttcgatctagctgaagagtacctttccacccactatcgacccagttgatgaaccctgcaacccgctgatcccatgtctctctgacaaacgcagggtctcgaatgtatgcagaaatgggagtagtggggagagcatggataccaataatgtactcggggttcataccaaagtacgttgcatggtcagccttgttctcaaacgaaataccagggaccttgttcttgatgaatttcatgggctgattccggttgttgtccttcatgtaccagtaggtgttcatggcacgcttcattatagccagctgaaggttggcacgggcctccattgcctggttaccactggaattaccccagagcttgatggcatacaccgagtggtagtcctcagaagaagactcttcatccttaccatcagcactaagatacaggccttttgcccacgaatgaccggaccaccagtcgaaagaacgatggataggaaagctcttatcctgagaactggggttagcgtagtctctgaccagattatcgacccactgtcgattctgactgagccatttcccgtcccccagctctttatctatctttgcgataatagcagcggcatggacaaaataaccatagtggaaatggtggtcattgtagtaagagttgccgaaatcagcggtggagtccgtaccaagacccgcagtagagactatgcccttccagacggtgtcgtaggcaagaggattctgctgtctgttattggcaaacacagaaaatgcattcttcaatcggccaagaagatcgcgcgcacgtgccttgtctccaacaacatcgttcagaaccaccagaagctgggcaaatttgtctagacccttgccggagaagtacatggaatcgagattggtctgagagttgatatcctgtagcatctcttggttggcagcattggcgataatgccgcgaacattggcatcatcgaggcgagacttgtagtttggtagaatcgcctttgggagatatcccacatctcgaggcagcaagggctcgaccatggtgaatttgtccgtgatgaacccacgcatctggcccttggcaggggagtcgagggtcgccatggtccaagtggatagcatactgtctgtcatgctctggacttggtgttcgagtgcgaacatcaaaggtttgccccatctgctcgagccggcatgcttgaagttgatgctgtaagatccacgaagaccgtcctgatcaatgttaccagagacagaagcccccacagcataacttccagccgcagaatccaaggcatactcagaagaagaatcaggcagagcagcaacctgaaccacaaagttgcctcgattggtgctgacgagacggttgccgctgctgagagtaaagtggatcgactcacccggagggacagtaacgtacatgagccacgtaattccgttgttgagaatgagtctatacttgaggagatcgaggcgaagagaggtttcttgctggacacgagcgaaaccaacctgagaagcaatgacaggagtcactccgtagtacttggcagtgaccatacccatacctctgactaggggagtccacatcttgagagaaccactttcatcgagagtattggcgttgacactcatgtggtccagggagtccattctcatcgagatggtggaggagaactcgcgtgcgctgaagactatagacatgataccggaggggttgaagtagaattgagtcggagttcgattcgggtctggtccatacacaagttgactgcgccgagtgtgggatactgctagtcccgaaaagccatcctcctttgaccaccacacgctgtagggatagacgtatgctggaagagttcgggtgcccagcagcatgttggtgtagaagttgtttgtgggaacggcccctaagggtgtatgggagcttccagtgacaaatggcggcagcttgacggggtgttctcgtcggggaaacatgcccaaggggtcagcagtcgagataggcacgaaagggtttccgttgaaacgggccccgaacgcctggcgtttttccagttcgtgtgtacccgactgcccgtgcgccagcgcactgaccaaccccaagaaagacaagccctgagagaatctcatctgaccagcagaaggctttgttagtgattgttgtcatggagacctgtgacgaggtggttatagatcatggacttctttttgttttctttcttttttgccatttggacaaccaatgagtaaagtgctgtatgtacttacaaaacttgaccagcaagcgtgtttgtgttgagcagcaagatctaggaggatggcactacctagctgatgaatgtgttatgcagaaagaagctggtggttgatactgcgcttttgtgtgtgaggcgaaagagtgtcacggtcctgaccacaactatatataatcaggatgggtccttcatcagatgttgtcctactcagctgacagacgaagtacatactgtaacaatggaagagactatgttcgtttggccaatcggctcagaatgtgaaacacgagaactgtacagtatgagcgcaaaagcgtctactagaatgcattgcttttcttcaactgaagccatactgagccatatcagtcacaaaacctccaattcttggtcgcttgatggtgtatcaatactgggtggtcgacaggaagattcagggttcgggagagtgtcccaagcggtaacggtgttgtctctaaagctatggatctgcttcaccagctacgttgccttcatgccgagcggtgtagttggtgagtggtgatgggtcactgtgataatcattgatggatcaactggacgttattggtcacattgaattggcgttatctctagggcctatgcgatacactggcttatcccgtgtccacggatcatgctggctccgaaccatctatcagatagatgacttctagcggaccatgctcacgcttgtcgcagagcctggtatctgtcggatgacttggattttgcttttgttcttgagtgttcaagattataaatccatagttgaaattcgcagggggattgcttcatctggtagtttttttgccacaattcaaccccgcaaaacacaaggcaacctggccgagcggtctaaggcgccaggttaaggctagcaccttgacgaatatcctggtctcttcggaggcgagagttcgaatctctcggttgtcagaagcggatgcgaacgaaaatcagctttctttttttcccctttggcaacacccaacatcttggtgagatccctcacagtgccggtatgtggtgtacggagtcgactgaaaacgaattgaacatgaaaggaatgagttaatggatctggctcgtattgtcgtccaataatcattgggctccaggggaactcgaccaacttttggagcattggaaacgcagtcaaagttgagggaacctccgtcaggacctcggtcaagtttggtggaacctctaacaaaagaacgaaggacatgtgcctcgatgaaacacaggacaaaaagaaatactgccacaatgcagctatagaggacgacaggactcgaacccgcagcctttggaggacgtcgttcataagaaccgaaatccaatgcgctaccattacgccacgtcctcaacttgttggcgtcaaagaagatatcagatgggttgtgaatagaataaaaaagccaagaatcattacaattaaaagaaaaagaaattcacccagtaatatatataatctgcaatatttccgacacaataagatacgacaaattgcgcattcttctgtcagacttttcgagccaaaagattttttccttatcttgcatccaggacgcattaaaaaaccgtatctccccgtgttgagaaaaccaggttgtcgatcaatgtttccgcgatcgaaaaaaacccgtgttacggtagtagggattcaaccaatatctgttatttattttcgttgcaggtgcgcaagaagtgagtttacagagcatttgcaacagctataattcgatactcgtacgtaatactcaagtttcttgctgagtaagcgtacaatacaagtatttcaagtgatttggcggtcatgtgactccaaagactcacctgaggttatccattcttcaagtgatttttttttttttttctgcataaacattcatttaattataactttgctgtgaaagaataacctttgaaatgaatgtacgcttacacgaatattactaattaaacacgtttagtgtcatggtccaacttggcacgtacctatttccagtaaaaaaatcataaaaaaacctggttcagtccgtgttgtatgttggtccacatagcttcgcgtgtttgttcgttcatcgggaaaacgccactccagtctccagttctctaatctcaatccttccattgccctcttcgtttgcattgcctttgaaaacgtctccttgtggttcttcttcgtcattggtttggttctgcgtcccctgtggtgactacgcgccctgctacgctgttctctcggtggcctcggccgccttttacgcttgctactgtcgctactctcgctcatcgtgaagtgctggcggttgtccatcgtagaaacacatctgggcttccttcaggaattgaagcaaaccctgttggacatgtcccagggtggcgtcgtcccctgagtaccggagggatctctccatcttccagatcccataagccaattcccgcagatatttgcgtgtcttgacttgttgatgtttccggggggcgtcactgttcacatgccctgggaaagaggggagtactccacatttcgactcggtaaagatccagtcctttagagagtccactgacggaatcttcatcctggtcaacatggaaagaagaacttcgcacttgcagaagatatgctcgtgcagatcctgaatgatggccttatcacagagcccgcatcctggattcttcttggtgaaaacgtggtcgtcagggtatctccatttcacgagcggaagtcgagatatccgcatgaggtgaagaacttgtgctttgttggcgtcggcgatgtagtgttttcgaaggtcatgcattacctcctgccagaccatgtcgtcagcgatgcccccgtagtcgcttcgttgagtccacttcttcggtcgtgcaagtgtgtgtgggaagtttggcaagtcgggagacgaggtcttgtgaaacatgaagttctttagagtaagtggtcccatgctccaccggaggtggtcgatttccgctgtggacaccattctgaccggatggtatcgtctcgcggctgcgatgtcgacgtgcgcttcccggaaagattctgctgctctcacgttcacctggtttcgttcccagattctgtgattaactgtgtctgttgtagagggctcgtgatcttctcgagggttggcatgttccgcggtgaggggcttgttgagctcgaaagaagctctgattgcgtctcgcatggtgggggaggctgcgtagccccaagcttggcctgtcggaaagcggcagtcgacgcgctggtgtggcttttcctgtgtgagactgtgagttctgctgtagaactggaaggtgcagtcccaaagggccggcgatgagccatggaagaacctgtaagcccgagcggccttcaggcacaccatgaaacgtcccatgtcccgcaggttcagtcctcctctgcctaccggagtttggatgaaaccattgctgaaggttttgcgtgttttgtcgggtgataatttgttgatcttgtcgcacgctagttcgttcagctctcggatgaaggtgttgtcgatctggctgacgtagggtccaaggaaattcagtttcgagaagaagtagatgttgatcatccacgccttgctgtaataggggagaccccatagtgaaaggcgtcgcagcgactccttgaggtcctccttgatctgagcgtagtgcgtgtccaacctttcgcgatttccgaagtgtactccgaggtaacggaaaatgttgtcagatgtccggagcgtcggggcctgtcgtgtgttgttgtcggttggccaggtggcgtcaattgttcgctgccattctgcgtcaataaaggttagtggaacaaaacaatcgggggggccgatcttctgaagcaccgtctttgacgggtttagtgtgaggcctgagacccgttggaagaggcagagcactctaccaaccgtggccacgtcctggatgttgttgaggaacaccgctatgtcgtccgcgaaagccgacaccttcatgtgtccagctgccactgcctccgggtgagtagggggttgtggcggcctgtgcccagtggtgtggtggtgggatagtggcaggcctggggccagtccaaacatctctcggtccagacgacgcacaagtgcgtctactgcgatgatgaagagggttggagagagagggcatccttgtctcactccgatcttgatgcggactgggcgagataggacacctctgatgttgattctcgttactgcgttctgttgtacagctaggatacggttgatcatcagttccgagacacccacatttcgaagcgtctttatcacccaactctggctgatagtgtcgtaggctttccggaagtccagtgatcctacgacccaacccatgttcagctgggagtaggcgttgcaaaaatgatccatggtgtcgagattgttagtgatgtgtcgacccggtacgaaaccgttttgggcgccgtgaatgctgtccggaagaatgttctggatggctttgttaatgagctgtgtgtagatcttcacctctgtgttgatcaaagaaataggcctgtagttggagatgtcggcctgatctcccgacttgtacagtagtttgatgatagcggtgttgcgttcggtgctgatgggcgagtcggctccagcttcgttgtagacgtccgtcatcaagtcccccagctcatcccagcagtcgcggtagaacctgtacgggatgccgtctggccctggcgcgctgttgtgcgtagacgccttgatggtatcgaagatctcctccttggtaaaagacgagtccaggcttgggttagctgtattcaccctccgggtttcttcggggaagaggtctaaaaaggcgctgtcgtcggtgtcgttgatatcggcagctctgtcgaagatgttgtcaaagtatcgagctgagatgtcgcagagagaggaggtgtcggtcttcactcggccttggtggttccgtagggagtggatctccatctgttgcttggattgttcgacccgagcatggagcatcgggtatggctcgttagctgggtaggcttgccagtctgaggctgttgccatgagggcctcgcggcgtctgttgtctgggtggttggaatctcgaagtgcgcggtttttggcttcctgttggatggtgaccttaatgttttctttcaggcattgcagcttcaggctgggcttcaaaggaccatatcgcttcagaatggatttgacgtggaacttgagccaagcaatgtactctgtatcaaaaacccaccagggcatcctccaggtgcctgggcctctgtcttgtcgctgggtgaggttgccaaagttaaagacgaattggaccgcgtggtgagaggacttcgtgatgttgtgaccctgcttgttggttaccagttgtgtggatttgatccactgtgagagtgtcgaagagatgtgcagctgatccaggcgcctgccagctccgcggctgttgttggtgtgagtgtagaggccttttctgtgtttgctgattagagtgtaggtgtctagtaagtcccagttagctaagaagtccttaaggtgagtcgtcactttttcgccaatcctgccgtcgttggaggcgaccgcgttccaatcgcctgccgctatcagggggtattggcagggatggaggcgtagatagtcgtctagtgactggtagaactgccggttagtgaagggggaggctccctgctcgtttggtgcgtatacgttgatcagcgataggtgtctgtcggtgcctttgatgtgcacgtcggccaaacacagtctgttgtctagggctgggaagtattcaaaaactgttgtaaagtttgtgatggtgacgttgtcggaatagactagccccacgccgacgcttctattagaaacaccagctgtggagccgaggagggtgtagtgtctgccccccgggtagggcgagtttgaaatgatttgttgagcggtttgtagggaggagtccacccagttcgtctcttgaagaaggacgagatcggggtagtgagtagttcgaataatgtttacaatggtgtcgggtaatcggttaagcgcttccgccatcttaaaaccgccgatgttagccgtgatgactttaacattcggagatttcattttggcctgggtgctcttacatggggctttagaaggggtggtagtagaggtgaaagacatgcttactggttctgccccggtcggagcattgtgtccacctcatggagagtggtcaccctaggggggttcgggggactgttcgggggttctacaatctcgtctaccgagctgagtgtcgcaccgtcgtggaaaactttgaagtggcatgtagacaggaatgtcgggcacctcccgtcaatgaactttgctacctcctgagaaggcagccagcagagtctgttctccgacctgtccgggttcaggatttgcaccggaacctcgctcgaggcggtctggaagaccgcaatgtgcttcttgccgagcgtggtgtgagagggctcgccagagaaactggaggtggtgtgccctcctcggggtcggccctcgtggatacttccgggggggggttgtgtttggttggtcgtgttgggactggtgtggtcgtggggaaggccgttgttggtggcctcggtgttaagcggggtagcggggggaagaaactgggtgacatcaggggctacttcagggtgagcaagtgcgtcaggctgggtgtcaaagccgttcatggatacgtcagccggttccgtttcctggtcgtcgggaactgtgtcttcctcggaggcggggatgttgatgggtagattctgagttccatgctgctggttcgtagagggcagctggttagtttgctcggtctcttcgggtgtgtcctctccggttttgtcgctcaagacttcaaagttgtagtaagatcggaggggcttttgaccggtgggttggggggacgtgtctcgagtccgtctatgtctaggggacttagtgccgacggtctcccactggtgagtagcaggcgtgtggtggaacttgcgagtttggaccgggggctccacggtggatggggcatggatggaagcaagggctttacctctctgtgggagggtaccctggtgagcgcgggtgcggaagatcttgggagtgaccatgtctttctcggggcaggcctcccggatgtgcttagtgctcttgcacttaacacagatgttatcgccgttggcgaagtgcatcttgatcaactttgagccggtaagcctagccttggtgggatccaggttgacgaagaagtcggggatggtctggggcagggtggagcctaggagagcacgaactgcgatcacaggacccgagatgttctgatggttggcagaggtcatcagaagggtgccactcaagagggaggaacctggaatggcctgatcaatgtctacgtcgaactggttgagaatagcgttgaggtggatcttgaaagcatcctccgtctgacgctccatcttcatgtacgagggtaggttgaagtagtaaagtactcttcgtccagcagggttagccgagcccttcctcatgatgcgataatcttgagtattggcctcaacaatgagactaactgtctccagaatgacagccattcgttgttcgtgggggtcggtgagggcgtccgacgtcaggtagtgccaaccatttcccacttggtagcagtcttcagggtcctgttctaagttagtctggtcgatcaggtgggggacgatgtctaggttgtgcctggacaggtcaaactccgccagaccaacctgacccttgatctcgtcgaacttttcgatgacgccctcgaggacactgatggtgtccttctcgtcgacttcagcggcgttatcgaggtgctcgaggaacatggagataggaagattccaatcaggggtggcggagcggtcaagagctcttcggaagaagttttccttgctggctacataggacacgttgaaacggccggaggtatgcctaccattcggcgccgcaaggggctccgaaattcgctccttgttgaggttgaatttgagtgtggaggggttcgatgtcaggagagccttgacttcggccttgctcttccaggcgttgagggtgatattgttgtcgttttttttgtcgtttttgtcgtttttgtcgttttttttgttgttttcatcgtttttgtcgtttttttggattttttcaatgtcggtttggttgggggtttcggttgaggtggctccatcacctcgcgataaatcaggaggtgggtggttcggagcgcccaaggagttacccgccgaagcttgggcttgcgctgtttccatggtgaacgttttttctggtcgcgctcgattaatagctctgtttttttgtgtctagtttcttcgagcgctgtatcggggaacctcatattaaggttacccaacaaaatgtaagtattctgttgagcgttgtcagcaatttaaacaagcaccataaaatcccaattagttcttcacaaacgacatgaaacacaaacacgaggacatgctccacatggtggaacaaatcttcatagagttagttgaattttagtggatatacggcccaaacatcactttttaggcggccgaggccaccgagagaacaggtgtatttctgacgttagcgttgataatgcagggactaatgagatgaaaactttagtatgcactacttcgaacccaaaaaatcgacattgtcaaagccgcggtcaaatggagtcgatttctcggttttatataatctatcttcacacgaaccccgcacgtaaaattcaggccataatttaaggtcgcattctggttatagtttaattgtctgtttgtgcaatataaatatacccccaatttacagattctccagaatcctctcttcatgttaaccatcatcgccaagaatccgccaagtacgtgtttcgtctcgaacactgaaaaagacggcttctttctgtcgccggctaaaaagaggcggcttgagtgagtatttatgctttcttccattcgactggcaccattgggggcttttggcaccattgtgacgcaaatcgcgtgtttgtggcacaaaaagcttgacaaacgacagcacacaacatcacattgcatcatggaatatctcggtttcgttacataagctgatgacactgcaactatactcactgtcgccatcaccaaccacgcttttcgacgacggatacctacaatcaatccatgtggcccaaacacaacaacaccaagtgacacaaacacgacacagatatactgtacaaaacttgacaggcttcttatgttccccgcaccttgatcatctttcaacctagtctcagctgcgagaagtgttactcctcaattgccagtgccacgccttctcctccgcaatcttcaacatactaactcagatgggcgtcttaggatctagttactaccataggtagggctagtcttagacgggtgcttcccgaagagctatgagccaaacgactgtgtcttccgagggtgtcgggtaggcacagtcaggccagagtctccaggggggcatctcaatcccagggaggaatttattttgtttacagggggggtgtgcgttaaccatgcccaggttccaagcatgctatgaactcagggacagagtctcatagggagtgccccggacaacccgtgtctactggcgattttcgtctttagacacgacgctacaacccagtcagtttcaaaccaacttgcaatcacccttcgcgtcccaagaggggggtctgattgcacagagacgaaaccatactagcgtcactcacgttctcggcggaaccggttcgtgagatttacttttttacttgctatcgatgataattttggcactggggatgttggagcataggagatggtgctcttggtggtggaaggtcggagtggattcgggggcttgtgtgcaagacaggaggcgtggggatagtgaggggcggtgggtggtggatagtagatgaggggagttggaaggaggtgatggaaggaagacgaggggcgttagaaggtggcgagtggtgacagttgaggggcgttggaacaagcagtggaagatgaggggtggtgggaggccgttggccgtggactgtggatggttggagtttgtggagaatgcactggaaccctagtcttgtgatccgtgtgtgggggagaaaacactgggatcttctgattgtgtggttttctcaatcacacccgtgtgtgaggggaaaagcactggaaccctcgttctcaaccacctcagtgtgcgagggagaaagtgctcgagccttcgggttgtggtcttctcaatcacatccttaagggtggtggagggaatgccgggagagtgataaggcattctttgtgtgggtggaatatatataaataatgtattgattgttttgaagctcatgagctgtatgaaactatcatttagaagcattacattgtattgtataaatactactgtatcggaaccgctgtccttttggcatcatctacggtccaatctcacagtcatctaagatccacgtctcacacttattgaacttccgaaacgcttattgggctgagtcgaacaaaatagggatcgaattcggtagggattgttctttttgaattaacagttaggagagacgatccatgtgcaactaggctcgggttagtctgagctgggtcagtttaaatggtccatgggcgcatgtagattgcggcatatgttttctgccaagccagtggtgcgttatctctcttggcacatgcattggcatctgatgataagggccaactgtgagttcaaggaattgtattcaatcaaggagcaccttgttatgaccgcgatggaaaaacctactcagtggagcttatggtttgacctctctgagagagtcgcgtggatatgtgtttttctagccgagtggccgtcagcttctagtttctcttccgcctaactgacaatcgccatggtcaatcgtgtaaccaagcgacttgacaactcatcgtctctccaaactgaggtggtcagggttggtaacaacgctctattggactggggagttcgaggctcagcagatattcaatgcgtctgtctccaactgcacaaagtgttaacaaaagcattgatctcggcacaatatcactctcaaagtccccacggtctccccgcctgatctgtccgacctccatttcgttctgaggtccaaaacaaggaagtcaccaatcactatggccactaagcgaggtctgtgggttatctctagaaacatcaattcatccgggggtgttcaagtggcttgtgagaaagagagtccaatgtgaacaggttggtcagaggacgtggatcatggctcatgttcaataaaagtttcaaaccatgtgtaaatggagattgtctagcttatgagcccctttactaacaggtttgttggtactcgcagcgtttactagttcattttgtctatctgaacgttctgtatggttcggctcataagacgacactatgaccgactgcaaaaactccgtgaccgactgaaaaagtgattacgacgcaataacacaacccagtcgctacactcataggctgggctgagctggcaaggacgacaaaaagattacagcacccaggattctcgtatggtctcccactacaatactaattgggctctctggagcttgactatggctgatcggacgggaagccgtattttcaccaggatatggccgtaaccaagttgcgccgacccggaatcgaaccgggggcccatcgatggcaacgatggattttaccactaaaccatcggcgctttggaggtatttcggggaaaaatattgcttactaactctcaaaacagtatttttcgaaactttagaataaaaaaactttatttttgacaaataatggagttccccatcgtgctctggaggtggagagaactcgtaaactaagacgagaagtacgtcaatgtcgattttgagtgttttattcctattggttaatttctgggtgtttcaaatttcgaattcgtctccatatgtcttcagttttggttccatactgtatatactgtacgagtgaaatattcaagctgacccagaacaacatgctgtgtttgcaattagtgacatctcctgggggacaacaagtacttgtacaagaacaaacacaagaacaggaaaatgagcaagaaacgtacatttgtattaacgagactcatttcccttactcaacttcacttggtatgatccccaaggttctggaagttcctcatttttctctaaatgaacaaaatagtaacaaagcacctataaggtagaataataactgtcactcacttaaacaaccccttaaaactgtttggaatttggagctattacttgtaacgcatttttcgttgtttctggggatttttttctgctttttttttatttttttttattctaatgaacattgcaaaacaggtgaaacaccctttacactctcgtgtgattcatagcagccttcgtggccaagtggtaaggcgcagcactagtaatgctgagatcatcagttcaaatctggtcgaaggcactttctttttgcttctcaaggctttttctttggttcgaaacgagacagatatgccatacctactctgtcatattaagttaaggttcgatgagagcgttgaactaaaaatatttttctcatgagtgaaaaatagcagctggaacggctacaaaaagatagcccgacgtggggcttgaacccacagccttgagatagctttgaataagagtctcacgctctaccgattgagctagccaggcgaatcttggaaatgtttggaagaaatcccactcaatgtcacggtggattagtcagccagaagtgtatgatttattgaacaccaataacccggcttactaggtatatagctgtaatgaatcattagaataaaaaaaaaactaattgttagaatataaaaacagaaaaaaataaagtaaaaaataaaaaagtaataattcattagaaaaagttagaaaaaaataaaactgaaaaagaagtatttttctaaaactgaaatgtagttctatagaataaaaacaaaagaaaacagattcctcgtttctcagcagcctaagacggcagtatctgatacgactatcacagcttgctttatttgattgctttatttgattgttgatatatttgtgcagtcagagtactgaagatcataaggaataggcagaatacgtgaacaagcgagaacgaataccatgcgctcttctgaacaaccgaattcgaatcctttttgcaggttataacattgtctttacgcctcaagtaaatgtatttccatagaataaaacaaacaaaaaacaaaacaaaaaacaatgaattttattttcctagatacaaaaaagaattattagaattttttaaaactaataggaaaaaacatattatagccgtattcgtcattagaccaataacacgtctagagaaagaataaaaggaaaccattggcatgtttgacatgtacccttctgtataacccgaatccgagtccgatgtccgcttttgttattgtgttagacccagtgaagtatgtacagtagcagaaatgtttcccttgaagcaaaaaacactttatgagagggctagtctctagtcagttagtatcatgattattgacacctactcgagagtatataactgctatcggcttacggtagtatatacacttcctcaagagtatataaacacatgccggtctaccttagtacagtatgtgacagtttataaggaatcgattattgactcttgcaacaaaatattggttcactgacctgtccattgcaagacggcagtactaccagttaagcctaccagagtccaggtctggtttcgaacagaaatcttgagacctctgagttggtctctgggttggtatatcccaattctggtgtccaacttggcccagaaaaaatcaccagtttcctaaacgagcagaagatacctttgacgagagtaccctcggatcatgagagctgttgttcccgagatgataagaacgaggtcaaattcggattccatctcaatgctccccggagaccgtcatcaaaggagacgatcttccaaagttttagttcgccaaactaacccgtccaaccatgcttagttgctcacgcgcgatcctgagggcaggccttccgttctcttatcctcaagtccctacggtaccctcaagtccgttccactatactggcaaggatggctcgtgcgtgccttccatcaacgaccagcacagctgatggacgaacggtttaagatgcaatgaagatgtggggttttggaaacgacacgggactcgcgcacgagtcggaggaacgagaggcaagtttcagatggccatcaacaaaaataatctcgcggaagatcgagcgtttatggagaagaccagtgtcaagtatagacatggtatatgtgcattgatttgcaggttgaatgttggagtttgacggaacgtgaagagaacacttgggccattattttgcaagtgatacattcgcaacatgaacttgaactcctcgtacacagaaaatgcaaaccaaaaaaggacgggcccaaccgggaattgaacccgggacctctcgcaaattgctcaggacaccctaagcgagaattataccactaaaccatcgggccattttcctggaaaaacctaaaataaagggccgcacaaccagaccaatgattagtaatcagccattttacatgtgttcatgatccccgagctatatcatcattttctatcttctcttgcttcactcgaagcaccttgtagtgttctgacaagtattgctccatactcaatcacgttatcccaaagtgaaacaccctgtctccttaattacgcgcgtgcaaactctaaagtgagtatatataacgtggctgagagaaacctgtctccagccccctacagcatacacataactaacaccatgtctcagcagcagcatctggaagaggaggaggaagaggaatttgttgacacctatgtgcctggcgagaagaagtccgtggcggagtacgtgaacctggacgctgaggacgagtctctgcgaaagtggaaggaggctcttggaatcacctccaacgtggcaggccagacggtgggtgatcctaacgacaagcgaagggtcgtgatcatggagaacagaacctatcttggtgatgacgagcccatcgtcaagaacctggaagatcccaagaccatcgaggatctcaagactggaacaatcaagatcaaggagaagatcaagtactactctgagatcaaattccgagtccagcatgagattgttaccggtctggtctaccagcagactatctctcgaatgggagtgcctatcgagacccgaaagcaggtgatgggctcataccctcccaacacccccgagaaccccttctatgtcaagaagtttgagctgcaggaggcaccctcgggatttctggtgcgaggaaagtaccttggccagtcaaagtacattgatgacgacggtgtcgttcatgccgagtaccctttcaactttgagatcaccaagaaatagaagtttgtatatttatcatacctgcagtttgacactgcaatcgtatcagttgtgtatgcgcggtgtttgtaggtgatccagtcgaactaaaacatcaggcccaccatcgatttacatatcgtagtggcacaagtatgtacaaaagagtacatacttgtacccttacatgctcgtcacatttctactcgcgactgtgttctgttctacaactatctaaacaagtatgatgatgccaaagctctcctggctgtactcttttccgtccaggtcggttcttggggcttgtactcttgtcccaccctgtgtggtcagacaggtgcattgtgttttactgtctctagtccaaatctcgtcactggtacctgggatgtcttactctcattacgccctgatgtcaaccccgaggggaaccatctcgggaggaccatctctgggaagcgaaatccagccttcatgtagattccttactttgacagagcccggcttggaaagatagaatgtcttgtctccgggatgatcatcaatccaggtcttgccgttaccccagtatccaaagcgatcgtctgggttgagatattggtagttgaaatcttcccatctgggttctcgtagaacagaaatggcatgagagatagttccaggccacgaaattcgcacccgggtgtcaccgttgcgatcaatctcggtaaagtaacctccaattccgcccttggtgattgacgaggcctgggacagttcccagatacgtctggaaaaggactcggagggtttctccttcggatcaatggaagcaatgtcttcaaactgcgcctttcggatcaccttggcaatgtagctagactgctgctctactgttatgggaggagttccacagtagagataggagtttaccgagagggtgtagaaaaagttgggaaagccgggcgccgaaactccaaggtaggacagagagtagcccttcttggactcaagaggtgagaaatgtgttcgtagagtgtacccgtcggatccgatgatttcataattgggagtggctccatatccgttacctcgaacgtatcctgtcgaagaaatgatgacatcaactggacgttcttctccgtcaaatacgataccattctcagtgaaccgctcaatgtcgcccttgtagtagtccacgttgggaagagctagagcctcgagatacccaggagctggaaggagacgtctgggtcccggagtgaaatgaggcacaaccttttcaaacagttcgtcgttttcgccgacccgaaggtacatcagcgccagcagttccttgatgcccgccttgtagcccggagttccaaacaaagtggcttcgtacttgccatgcagcttggagtcaagagaagaacggtacttgtggtactcttcagaggactggatggcgttgatttcttcctgagtgtagtcgacgtaacccggagctttcacgccgaatagtgtgtggcctatccaagctcctcttttgacgtagtggtccacgtgagctgcaccctgtttgatgagctctggcagaatctggacccctgtggctccattccccagcaatgccacccgctttcccttgaggttcagatctttaggccagttgacagggtggaatttgggtcccttgaaggactcgaagccgggttggacgggaaacttggcagtctggagagatccagatgacgaaatgaaaaagtccgacttgagaacctcctcttttccgttgtgttccactctgacatgccattggtgagttggttcatcccatttggcctccttgatggaatggttcagtctgaacttgtctgcaagcccgtgtttctccactctgctctgccagtaagcctggatatcctttccgaaggcataggcgctctgccagtctgttttgggatcaaaagtaagctggtatgagtgactgggaacgtcacatcgcacgcctggatactcgtttgtagcccaaacacctccgaccttggagtttcgatccagaacagtcagagtcaaattgtcgactttctgagacagcaggatagctgtggtgattccggcgagaccagcgcctgagatgatgacgctgacggcacgtctaccgagatatggccgctccaggatcttcttggcccattcgctggcctccaggttgttgaactgctcaaactgcgcaatcagcgcctccttatccacccccgttgtgtccgtgtggcccactccgagtttcacgttggaaggatcaattgagggcatggctaaaaggcgattgaagttttcggtcccgtggaaagagctgacggacctccatatataccccacagctcgtcattgtggttgcataatcgtcaggcacgacgccacaactcaatctgctcgcataagtggagatagtagtgaagaggcgatgatggcagctcgaaaaagaggtcagtggggaaataggagtcacgtatttgactctgtagtaggcgttctgtgtcttttgctatcttatcggtattaccagcatctctggttgttcgtttctccgttctgtggcttgactgataagagtgagactaagacggagatagtggaggtttggtggcctacttgtagatgacacgagatgggtggataagtttttggtgattggtctgactcgatatctacaagtgattgtaagtaaaaaccccagctggtccaaactggtttcaatcgctggctgcttctatggagatttacaagggttagtcagggtccatacaccatcgccctacttaccaaatcttcaagtgtttttgtttaactactgaccctgccgtctaaactcccaactaatgtacatcccgttcaacaaaagcaactcaacataaattactcatattactctatacaatacaataataaacaggacaggtccaccagctccacaattactcccaggtaagctctgcaaagtacttgtatctgtctgcagatcttcgtctcaactccttaccatagcggatcatggggtagatgagaagaagggggatcacagagagacatccagagatgataaacacggtcttgagaccacatcggttgatccagggctcgagagaaaagcaaacaatggttccaaaggcgtttcgaacaaccacaacgcccacaaacgcgtcagcaaccatgtccttgtagcaatcaagcatgtaggtgatggagatggatcccactgagccgaaaccaaacatgatgagcgagaagccaaccgtgggaatcatccagtgctttccctctgcaatgggaatgccaaacatgaatacaccgacagtgacggcgaccgctccgaggtacattgagtagagacgcatctcaggttcatacaaacctccgtttcgtttggtgagccacaagatggacttgtcattgagataaccaccgaagacagctcccagagccataccaatgaaaggagcaatgttcacgtttccaatagcagtggaagacatgttgtagggctcgctggagaaggagttggcgatagtggtagcagccatcgccagccaggtgagcatgaaggcgtagttgatggccacaaacgagacaatagggaaggtgaagagcacaatgaaaggcgtgtacatcttcttgaagaagttcttccatgagccaggcgagtatgtccacagagcaagacgctttttgagaggtcgagggtggtagacaatgttgtcagccactgagggggtgtttgagtcaccgacaacaatctcgtgttcagaaacagcctccttgatgtccatggagtttcttctggaggttgattgagaaactggtcgagaatgagacaaggagtttcgtctggagggcgcctgggaaacaggacgagactgagacattgagattctcgagtcctccaggttctctctcagacggtcttcatggaggtatcgggtggcagtagagagaggagcatctgcactcttttcgactcggggcttgtcgtcttcttcattcacctccacgtccttgtatgtgatcagtgtctgttcaggaaggtactttgtttcttcaaagaagaagaaagagaagaccaagaaagctccgtcgataatggcgataatccagaatacccatcgccagccgagcgagtcggtaatgtatcctccaggcaccagcacgaggaagttgccgatatcgacaaccgtcatgaaaatgccgttcatggtacctctctggtgcacaaagaagaggtcagcgaccgtcatctggataattgtctcggtcagcgaagcagccagaccgtcaatgaacgtcgcaatgtacatgtcataaggatggtacattttggcctgccagatggcagttcccacaacggcagcaataccacataggtagacaggccgctttccaaacttgttggcaaagggaatcagaaacggacatcccaggccgagaccggcaagacccatggcatagccgttgttgagctggtcaaacgtgaagcccaactcctcgttcaatgggccccagaacactgtggggatacaattgagagcgaaggccaacaacgtgaagaaacagacaacgaagaagttgatgccttttcggtacttgttccagttgagaggctcattgggatctgcgctgggcttaggttccagaatgatatcatttttgccgctgtccagccgctcagggtccagaaatatcgttccaggggggaattcgtatgggtccatggtgtgtcaagagagtcaattgtgtctccaaaacaaccagcaactgcgatcgcttatatgtctgccttgtgtgcggaagcaaccgttgtgtcacacattcaacacaaagacaacagcgcgcttcctttactgattctgcacatgtcgccaagacgttggtgatggtaaagcgcctgtatctgtacccctcttgccacagggtagtaccccgtaaccagctagcagcggatcgccaaaccgctcgagagatgttgcttgggggtgtatcgatctatcacgtgacccggatgagaccataccatggctccagtggcaacaccatctccttgtcgctctttccgatatcactccgaacacggtctctacaacaacgatatgcagggtttagacgcggtagatatttacaatctgaaataatgtgccatttttaacattttagacatttttaaggttgaggattgagccagaaaagcgagtcgggtatcgatcctagcggataacaagcagtaccaaatacattattggcggggttgccggctagaaattggtcacgtgatcacatttctagccggattttctgttattatttccttttcatttctctgtgggcgtttttcggttgcgtttacccccccctcaattctgcccgttttccggccccccaaatttaccccacattgctctttcctatctaagcatgtgtatgcggacgctatcatgggattgatatgcacatgtacaggtcggcaaggagcgcgccgatgcggtggagtggtggtccggatggccgaggtttccagcgactaaagcgtcttgtttgaggttgagaaatgacggagattgagaacttttggcggctgttgttgacgttacgattgatagttggggaagttaacaaataaagaagtttatttgggaaattgttggggtggctgacaagtcgtatcagccgtgcgaaccgatacgaagttggttggtcatgaagtggtgcaggtacagtccgatagaacatgtgggataggcgattattgcggtcgaaagggtctcgcgagaaacaactagtggtcgtacccggtattcaatccagtcttctccgctttaatggtagatctgtactggtggggacttggtatcgttagatcgttgtacttgtcgacaatagatggataagagatggatgagagatgatacttgtaacacccagtggccagtagccacaacccttgaaaggccgtccctattagaccaattaattactctgcaaatctctacgatatccactggtcatatattgcagcataatcctgccagatataacggccactcgtctcggtcagcttacactcgcgggaagagataccatacgacggccccgatccaaatggcagtcagggactccagcgcaataacaaatacgatgatcagaggtgcccaaacttggctccaagttcttccagatctttaatacgtcagtggtttcatgtcgatacggccgtcattccaccactgagaggtagagttctgaagtaccaggttggctctggccagtggaacaagaaacccaccttcaactctaggaaggtggaaactccagaaatacttcctaccaagaagtctaggtgctcagacctcgtcactgttgtgcgaagctaccacagcaactatcatgagccagacgaccctcttctgacccgaaaaacggcttctcatattctgaagaccctagaaaacagtgacggtgatatcgaaagggctgagggcattattgggctgaaagatgatgactttgtgacgacagactttgtgatgacagactttgtgatgacagactgctgtgacgactgtgtggtacaatgtcatcagtggggctagaaggaggatccagatcccggtgaccaatcattaaaagtctagggtatggacagtactgacagacaacagtcgattaatgagccaaaatcgcccaagaactccatctccgtgttccacgagattctggtccatgcgacgcaactatcatcaacttggacccaaacgaggtgctggatcaacttggtaggtcaaggtgtcggttgtgactgtcgcaggagtgtctttttgaatcagaagtagttaatgtgtatcttagtgtcttcggctggaaccagcgggaagtccgagggaaagagtgtataacagagattaaatcttaggcacttttgtattagatatttcttgactatgtgaaatcgctttgcactaatctacacttggttctgttgacgttacaatggcaaaaaacctataaacgtgaacaatgaaaatcatttcagagcaccaaaaactatgccgatgccttcaagacaccgaaacagaggctacaaaccagattcaaagccaaatcaaacactacaaccattttttcgccagagatatcgcgttgtccaacactcaaatagacaaaatacagtctatcgtcaatctgcctggctagctcaatcggtagagcgtgagactcttattccaaggtcatctcaaggctgtgggttcaagccccacgtcgggctttctttttggcatttttggtctgctcttgtctccaaacacgtaatctatgtgtgccattttgcttctcaaatttttcttcttatctatgcatatgcatgaattagactgggtctgcatactctacaaagtggagacagcggagggtatttcaggtcccgaaagtcgttaatgtcgactcattccatcattttgtttgatcatttgtgttaattcgagttttcagacctcctaatggtcacaaaaagacgtttttcgcattttccgcattttccgcattttccgcatttttctcgaaatttataatcttttatatttaaagtttttgttaatttttttttcatttttttttttttgaaaatagcgttcgataagccaacggctttggagaggaacatatcggcgaaaatgtagcattgtagtgccgaaaaagaaagacagacaagggggaaaaaagaggacgacaggactcgaacccgcagcctttggaggatgtcgttcagaagaaccgaaatccaatgcgctaccattacgccacgtcctcagaaattgttgggttattttcggctttcaagcttttaaccggccaaaaataaaatctcacccgcgatattttgctccaaatgcatcaagagagactaaagatgtgagaagatgacaattatttgaatgcaagtgttctgagtcggaaatatctggttcttactacgctgagatggaaatatcagattctttccatgcattgaatgtgtgattgagatttaatggtgtattttgttgggacttgatgtgtttagttagtgaatactacataatctaagtgggagtttaaatacataacagctacttgaccccaattgttaagtaccaccacccacatacacccaggaaacggaagtaataccaaagaatattcagtaggttaaatctccatgaatgtccattccaaacatttactttagcgcttttcattgacacaattatgaactttatctcaatgacgggcttgtgcagtcagttcccctcacctactcgacgacattgtacaatctcttctttttctacatctatatccccttaagataccatccatcaacggaaactgtggagacattggtttttatacccactatacccatgagaccgacgattgtgagaccagatgtggctgctatcggtcggtattttgaccagcagttggaccttctgaaggagaaggacaagacgagttatgaggagggaaaacaactgaaacgactgatgattggaggttacctcaatctgatctacatgcaatgtgacatgtcctattccgagtgggctggatacatgatggtcgctgtggctaaatgtggaggactggtgctgaagatgaatctcatgcgacacactttcgatctcatatactccctttactgtgggttcgctggggatactttagggagagatgaacgcctcaaaaagtacaaatccaagtatggaagcagcaaaaccacctataaagacgccaacgatattgctacggacttcagcaactcgtggggggaactcaacgacatttatcttggctggaaatgcgaaatggatacgcgtgacatagtcgccatgattgaggctatcaatcttccagaatgtggtttcgatgggcccccagaactcgagagaccagaattggatcccgctactcttgctactgagaattacatcatttcatacctgtggaaggctgcccttacaacctatgccagactcaagtattacggtctggatctatgggactacgatgtggtcttccagaaccaatcgcctccgttccccgcctgcgttttcttcgacctgctaaacaggtatgaacaatactgcggttggatgcctgtggggaatgtcggtttgtttgataccgcttgtgtgactgaagatttagtgaaagagagttcaatgggccttcactgtcatatcagcgggtgtggaatcccccgagcccggtcttgcacctggagcagagagtttttggagggaagaatggatcatcaccgaggggtggcagaacctcggctcaaagagggcaagctgtatgttagcgacatggcggactttgaccctgtcaatgagttcactgagatgaatgaaatcaaatcattgggtacaaaatacaaccctgagatagcggagtacattgccaacagtttttatgactaccgagttatgaatccccatctcttctcgagcaatgccgacaggtacatcggaatgactcttttcaatgccgacgacgaggacgaggatcttatacgtgatttggaggagactcgcttgtatggagcccaagattttctgaaactcatcaagagcgacttcaacggaatcaagacatgcatagtcaagagaaaattcgagaaaccggctgagataccctttcttggagacattaaaaggcttcagcagatcaaggagtttggttttttcaaggaaattcttacatcaggcccagaaaatgtcagaggaggactgttcgtacaggcatgcattgactatgccaacaactttgatccgcttgtccccgaccccaataaagatgcctgggtggaatggaccgtgattgatatgagtggaaatgagggaatgctaatcaacgacaagaaacttttcattcctggcacattggtggaaaattcagtccatgacgcacacattgaacaactttacaaagtgagggctgagggaagcgtttgctacggatacaactgctacggtcaagccctcgttgctcccgccttatattgcgaaggttgtccttacaatgccctgtctgccacatcctacaacctcattagggaagctgtcaagaaagaccctgtgaccagcattgtgcgtctaccgcttctgaccttatcagaacacacattggccatggtttggagaggtcgtgagcttccgaatctggacatttcatattggcataaggctctgggtcatgtgagtcttagggctctcaagagatacatgcggatcatccagggtatgcctccgtatttttggccgtacactatctactgtgatgagtgttttaagtgtgagaagggtgagtcgtcgtagcattgatggttaccaaccagagtgttcgtttggtagtcccaaatatgacgagatcatccaaaagcattgtgtgaattgtactgtacgtagtttcagagagcaagtacttaatgtacattctgtactagatatagaaccaaaaatgaccagaacagtgatcgatagccaaaggaaacgaccatggaagtcatcaccttcagttgttgcaactaagtcaataaacacccccttttactcgtgttcccaaatctctgtccaaaagacaccagggactacaagtggtagagatgcttggtagaaagagttggtgatttggttcctgtgagcctgtatcgttgattggttttctcggtttcgattgaaaacgcagcaggggataatcagtcaccatcaattgacagaacggcgtttggagatcttcatcaccattacactcgcggtaaacgtaccacagaccagaacagcagatgcaatgtaaacaatgttgatggagctggtcaaaaaggttttagtaggcttcttacgatcctatatatatatacatagcgtcctatttcactaagtcctctcttgtatcaacgtgttgttaacacagagaaagaggatttttcaaatatccaagactaaaggtccaataaaaaccaatgggcctcattgtactgtttttctctcatcatgtagagtgtcagaagaaagagatagggcggaggagaagtctgatattcctacacaaatccgtggcaaatgcatggccttgcaatgtctggaatatactgccatgttacttatctgagatagaacagctttcaatgagagcagagaacgtcatgtagatgtagatgttctcaaagtataggtgatacgaggaattggacctgggagtccttttatgcgtccaattagctgactaatctattgtgttttcttcgagtcactcaagaaacgaaattaacacacagaagccgtccatctttcttcgctctttgatttactgagcttcgaatggactccatttctgagattaggttcaacgtgcatggataatgcactctttgcagtatctagattaatatctgtaagacattaaaacaaagaggtttgtgcctaacagacgatgaagacctgaaaactacccacaaacaccacccgagaacgacgcaacacttccacccacaataaacttccgagaggccaaactatgccagcaaaccatcgttacaaatatcaacagttgaccagccaaccacttgttccagaccaagacatgaggggaaacttgaagtagcacttgaagtgttgcatcgaaggaattgcaaatcttaagaaagctatcgagatctctggccgaggaggtctattcggtccagacgagcaccgacgagtacgacgtctcacgggcagtatccaacattctcatgttactatctgccatatctgagctgacagatggttctaactccatggttgactcgaactactctccagacttgaactacacttcagattcaaattactattcagattcaaactactcttcagactcaaactactcttcagactcaaactactcttccgactctagttagctaatgaatcaatcatgggatctaaaactccagcctacagttcaaaaagtctgccttttacacatcaaatatactcaataactaccatctaccttcttcttgtcgtcctcctcaatgcagttgaccacctgtccctccatcacaaccggctccagggtcgtcttgggaccctcgtaccacctatgggcaaacagaaagtagtagagcatacaaccaccccagacggtgaagagaatgatacaggtgtagttcatggtttcctttgtgggatgtgatgaggtttgtgggaactcgatcagcacaatcacaaacactagatagaaggttgcaaacgctccaattgcggttgagaggaactttccaaggtagaagggaccgggaacaaacgactctctgccgtaaaacagcttgagagcaatgggaatgagccacgccaaagagttggcgcctgcagccagtgagaagagagctgcggccgctgcagcatcaatcatacataagcatccgatacacagggccagaagagcgtttccccagacacatctgatggggtttgagaatttttcgttgatcaccttgaagaagtttgaaaagggcagagcgccgtctctagaaaaagcccacgactgtctggaggcagcaatcacgttggataggcccatggtccactgcagaataaacagaacagtcatcattccaatagtccagttctttccaagagtgtcgtataccaactgggcaaagggctgttgatagacggttcctagtataggttgcacgtcgtggggcaatacggcaacaataacaatgatcaccacaaatcccaaaatccagcacatgcccaccgaggcaatgattccgaagggaactgctctggacgcgttggaagcctcttcggacatgtggacacatgaatcgaaggctccaatggtccagatgggggccagccaggccagaaagaagacccaggcgctgggccagccctccgtcatgttttcaatctggccaaacatgtatgctcccgagttgagatgatgtcttcctccaatgggtagtgcgatgatcatgacaacaataatggtaatgttggcgtagatgcatccagtttgaagcttggccatgtgtttggttcccagagaacccacacacgcgtgtgacactacacaggctgcaaagatgccgtagaccacgtaaggagacgggttccacttgccgtcagtgcacacaatgatcatactggtgaagatctgggcaaagccgtagtcaatagacatgataccccccgtcagacccagcgtatttgtgtatcctaccagaaaagaaagaggtttcttcgctttttctggtgcaaagtggtatgtccaccagtacaggcctccagaagtaggcagagaggagcccagttccgccatggcaagagccactgtgaagatgcatcctgaggccacaaaccaaccccataccattccatagggaccggctgggagcgagaaggacagggttgtggcaatggacggtagaagtcccatgattgaaaacgcgattccaaacacttggagcatggagaagtttcgcttcagttcgggcttgtacccgattgtggcaaggagatcagcgtcatcgcattcgcgaggagagatttgtttttcgagttccatcgttgaatggctgggtgcagttcttgcggtgggcacttgaggtcatgctggaggatgggttcttaaaaggagtgcgagggtgagctctggagacaatcgcggggctatgataatgactcggaaagctattctggggttagactacgactatctgcgtttctgcggtctcactgtagatctcggtgttctcgggcagattgtctgtaagactaggagagcgtgaggagggtttagatattgttattctgcgtgctacagcaactaaaaaagtaccaatctggtcgcccgaatctgacgagtacgatgatattgtttttgtctcgatttgggcactgaatcaccaaccagcctcgtctcgtctcagccacctccgtgtcttatcaacaacctaattaggaaggcgtagtccactaaaccttattttgcacaccagataagcgcgcttaatcgtactaaaccggaaacccgagccgtgatgcattgattatgcaggtgatatgtgcatcaccaagataggaaagtcgatgaaggagcgaaagagtgaaacaggaccattactgtgggaaagaccaataactgcttaaccatttggaaggacattattgaacacggttggattttggatatggacacaaccaacatgcccgaaccgaggatatacacgcgattttggtatcacatgttgaacttggggacacatgattccagtccaaaggtctgtctaaagataaatcacaagatgacgcaccggaaatggtacaagaagttgtacaacttgtactttactcttttcaaaacgcgtctattggtctctgtatgaagcagatggggctgatgaactcagagataggagtcttatcaagtggttatgagtgcaagtacaagatacgaaagttatatatcagagttattactgcttgtgataatctggatgggtctctttgtacttgtagcatgaagatcattgtattgtaatcatcaccaagctgagacatgtcttattctgcacagcataagtccagaggactccacaaaccacaaggcctgtcaacagtatacaagtatggtatgagttatcataaattgttgatataattattagttatctaatcacgcactcaattactgttggtatattacaatgctatacaaagccagctccgtttgactcgactcgatgttgctgagcaacggcaccctacggtgctgtatcacctcggtcagatctagtccttctgagagaactcgaccgtggagggaatgacacgtccatggctctcccctcaattctgtttcgcgtcattgtagatgcccgggagatgatcacactcggctggatgctagtcaaagactcccgggaaacagacaactcgccaggagcgtacggagccggtcggtctgagctgcttgtagtggccaggtatggagcagactctccagatacaaatgaagccgtggtggtcatactgtatcgttgttggggatccgaaatagcactttcagccatgctgggtgtactgatccgtcgactggggtcagaaacaccggatgtgctgtatctctctctcacactcggaacctccatatgcggacttgtgggtgcagacacaaactgcatgtctgtggtttgggatgcagggctgattagagggctagagcagtctgcgggagcatcgagagctgatggagtattcatcgatggtggagaaggaggaatgtggttctcgtcggcaacaagagctccagtctggtcccaaagccgctcaaaagaagccgtagacatggtagcaatgctcgaaatgctggactggtgagaatgcgtctcacgtatcatggagacaaacttgcctgacacatttagtggtggagttgcagggaccggtgtagatggagcatgaaagagagtagacagagaagaggagttgggaatatgctgaatagtgttcaacggaggaggttgaagaatgggagaagaatatatactggataatggcggtccaaacctggtcgtggttgacgatgacaaaccgttgtcgtcggggttcttggacagagtagtgtactctttaagtggacttcctctagggctgctgtttttggtagaatccacaggagacatgtatggatcgtagtctgacacatcttccacgtgttccgaggtagtctttgcttcttgctgattctctcttcttctggcagcctttctttcttgataagcagaatactggtcggcaatactgctgtagtccaataccccaggcatgtaagcgatggggatgatgttggaggcgttggagctcatggtcagcgacgagtcccgagccgtagacggtgttgaaaattgcgggagagacgtgtcctgtttgactgatgagctgggggacgatttgaacgacagcgacagccgtcctgtgtctgaaaagagagagccaagcgacagacggcttgtgattggtttcggaaggtggaagattgcagacagacctctgggctggtgtactggttgagctggttgggggacaatcaggtctggctcataataatgggtatcgtcagtgtgttcgaattgctggtgtagaaccggagttcggacccggttggtgcgttctcggcgtgtgtatatgagaatgggcgattttggggagctcgtcgatgagttgtcctcaaacagcgtgctgagactcttgtagctgtttctgtcttcgtgcagctcagcgtgagactctcggacgcacccgagcgggtcctggagttctcgcaggtagttgtcgtcgataatgatgcctgacgcgtcgcgtttcttcagattgggtgagcgggtgcgattgatcttgctcttgttgcggatcggctgtttccggtgcttcttgttccacaggatgaagaacataaccaacgccagtatgatgagtccgccgactcctccaagcactcctccgatgatcttgggagacgctgagccttccgaaggcgctggagtctctgaagcggtgctgttggtgcttgaggctgtggacgatgccgaagcggtcgtgccatcgctcaacgccacacagcgaagcggcggacacgtcgaacagtcggtttgcacccccataagacactggaacgagctcggacacatgagacagctaatgggcggaccacactcggcacagccgttctgcagcaccggagctttgctgggttgcagtaagagaaccagaccagctgtattggagggtagatcgatgtccagggctgtttgtgtcgggtcaacagccactgtggacgtccatccggccagggcaagctgggtggctgtcgctgggtcggtcaccaggggcgggagcgcgggtttggtagtactagccattttcgagccgaccggaagggcagggagggtagcgggcgtgtcgagaacgatcaggacgcgtggtaaacaaggatggagcggtttgcatcgccaatactccagattcaagacacattcctggatgtaacctgcaccgggtgcttgttacagatgtaggtttaggggggtggttgctggggtccataaagggggctgttatggggggtttttgactgtgaaaattggtactctgggtatttccgtcccgaaaatgacaatggaggcatcgcccactcaatatgttctccccaacacccgtttttccaccgtccacctcccccacggcgaaatagcctgcattaatctgcatacagctaatcaaggttgggtctaggcaaacactagtttcgggcttgtgtgcgaacaagaaaaaagaagccgtggcgaatatggccccagtctccagcaggctttgggggcacgtgatgtccacgtagggaacgtgttgtacatgacagcgtgactttcgtgtggcggaaaaaaaaacgtgtctgtgttattgttcctggtcgtggttgatattctgtagtctgatattgcgtgcggcctctcacagtttaatctcacagcggctcttcgcatgtgtgtggaaaatctgcagatctgccgttttggcagaaacggagaacgcgaattgcgggtcgaaaagggcgtttttggcgaatgaaaaccgccagtggtcttgctggtggctgccaaccatctatggcttctctccatgtttttttgctcttccaaaacccgctaaaagtgcatagtgcagggtctaccgtgtgccgccgtgcgtgtagtcagtgtcatagtcccaacttttttcagagcgttttttgggacataacgttagaagtactaccaagtagctttatagcaaaagcaataattttgcaggggggtggtgaaggtggtaaaggggtggtgaaggggtggtgaaggggtggtgaagggatggatgacacgtgtttgaccacgtgatggcagtgcacactgtagtattacaactaccagtggtagttgttgttttggccgtgtcaagagaccctgtttccgtctgttttggctgtctcaaatgtgaaacaaaggtgcagtttcacaattcaggagagcgcaggaatgggtttggagagaccgaagtaggggttttgatgaagacgagggtaaacatatatgtaaggagcgtcttgtacgttagcgttggttgcagtgttgtcgacagccacccgttgagaccaatggctacaccgtcggcacacatacacggtatgagtatgggtgggcgctcactcttcaaaggcttacatcctacagaactttgccgaggtgaaaaggagcacgagatgacgagacgtcgtgaagagggggaaaagaagagactcagcaacagaccgtcatgacatcaaacaatcggccattcacgagttctttacaaaacggttctttacaaacggttctttgcaaacggttctttacagcacgagttctttacgacacgagttctttacaacacgagttctttacgacactcgaactacgtattgtgcatactgaagtcccacttcccagtccaaaggttccttttcttcgtctgtttcaggtgtatgcttgcagccagtggaaggaggtgacccttggaacggactccttgtacgtactgtacttgtactcgtacttgccgtctcgacttctccacatcaattgactccgaattttctatctacgacaccattgcaacaccaattgaaacacattcgactgtatcaatgttgcactgaagcaacgtcgacaaagtgcagctacattgctacaactagtcgagagggagatggtagaatgattcaacattggtttcaaccgatcggtggttctgatgacagatcatcgattccgatgacagatcatttgttccgatgacagatgactggttctgatgccagatgaacattctctcacactaccaggacgttcactcgtttcctctgcacttctccgaagtactctcggtgggtcatcgacaagtggggatttctctatctcatcggatcacgtcctcggttcccactctccattcggttggtcggttcttctccagtccccactaacgtacaatatgcatctctcgcgcatttgccgaggtactcgacgcggcgcaaagagacctcaaccacgacaagaatcggtttcttttgtgcacaaacagcatattcgatgtgccgcatcatattcacgacattcgccatctcctctgcttcaacatctccagcaaaacgtgagtttacaacatcataccaagactttggcactgcggctggcctccgattcctgcatggggggcatcaagtgagttttgtgcgacagctacatgatggccgatttgcgtcatggcactagctcgttggtggaccagtacgggcttacagtactcatgctggacttgagcataagtcgtgtcatacaagagacctactttcagcttaggccgacgactcaagtgctttcgagttaccaatcccggttcttgttgcccatgagatcgtagggggatcttaagagggatctttttgggacttcacttaatcaagaggaagccgtaaagtgcttccctgtgtactggttttcacagtgagcaggctctcccaactactactgttacagtagcgcgatggcgtcttatggatatcatcaaaccaccaacctacagtctactacaccttgtagttggagcaatgccaaccattcactcagacagcctctctgaacggatcttgagcaactctgagcatccaccacttggtggacattggttctctcctcagcttgctgtcctccaactgttcagcaattgcgagtaactacagctctggtcgcttcaatgtcaatcaacgctcctcacacgcgatacctccattaattccgtatcataatccttgatatcaagtcattaaccatcgatacccactgcgataacaataatacccgacctttcaccaattcaattctgtacttcgactcgcgactcttactaagcactgtttcattcgtactcgactgagccgctaccccactttacagcttttgatgctctcataagatccagccgaatgttacccaaatgactccttgactcagttacccaaatgactcctttactcagcagtcaccgaacctacctttgattaccaaccgtgatacatccagccgagacatgtttgttaccactgcgaagcttcctcacataaccgaccatatggcaggtgcacagcatcacgtgtggcccccaaaaacggcgaacacaagtctggatacacctgatctgcagaccttcagctcttgaaacactagcggtttcgtcgttgctatgtctccatcaaagacgacgacacattcctgaatacgaatgttacgcttgcctgcctgcattcctcaggccagccccgcgaaaaagaaagtcagtccatccctgtaatgagaatttggtttccttttcgcaacctaagtcctgccgcgtgtttacctgctctagggttggatgcaggtgtagatttgctgcaggagtgaacacaggcacaggaacgagcggtaggccggtgactgacgcggtcctgcctgcgccaaacattcggtgcataaaaacaaaagttgcctgatgttttggaccctcgtgaaggggctgcttattcaatcaagggactggatggagcaccaatacctgcatatgtcaatcccatgagtggacccggtgatcttacgagtcatggagatcttacgaggggctccatttggggtatggaagagggtgttgtcatagtcgtgtccaagacaccaatcacacgactgtctcagaatgttggaccgttccacggcccgcggactgcaaacagcaccccccctgaagctgtcgcaacggttgtcagcagcagctttcacgtgtggcctcttgttttgtctctgccggtcgcgtatctccagcgcgtccgcctgtaaagtgcatcttccctgcatctttctattgtcgtctgccgatcttcgcggcatacaatggacgtgacgcgactctgagcttgaaaagtccaatgtaacgtaggctgtgagacatgatagcggcgcaggatatgccagggcgttacaggggtgctaaggggcagacctggctgacattgagagtgtatttgcaacttgcttcttgttttggtggctgctaatgtcaccaacatgcagggcacggtgcttactcacaccctacagctactgcttacacactcaccgcgaccaagctcagtcctacatgatagactgtcgctcacgattgacagctacatgacctgcgccgccacacgcgaaaacgcgatctcgcaaatccccgatcgtcacaggatctccattttcagatcaactgatcggcgacaggggctcggatcggcggtagggtaagctttctgtgagagaggaggaagaagatcatcagtggtgatagtgggtggtagtatggtggctaaggactgattgattggtgatttcgccgcggttttttcgacacttttggtgatggcgatgtttgataagggcagtatgtaggtcggtgagacaaggctgtgtggacaagggtgggtcatagagtacagcacccaagtacaagtagtacaagtacctgcttgtcgccaagcactaaactttgcttagtcttggaaggggtgaatggtggccaggagaagccattagtgcggtaggaggtccttgttggagctggttcgatatggcatgcttgtgaaagacccaaaacgatagatccaaaagcggcctggggactagactcccgccattagaccaaataacttgacattatgactgatgattatgacaccggtatttgtacattgtagttcaccgaagacactcgacgtttggcaaggtcagctccagtgcagtaactttcagatacacttaagcgagatgtgaggtacaagtctgtttgagatgtggagagatttggggtcaattgaagtgtctggagaccgtggacagcagctgcaagccatcaatatcatcaatatcgatcacttccaattccgtatgtcatttgcggatagtctccatctattttttcacgactctgctatttttcagccatctgaaaaacgcatccggacagagtttagggccaatgtgtaacctgggcgacggggatggagtggagagctataggccagtttgggggtcgttttggaggctgaaaagacgccgaatcaattgatatagacctcaatatcccgccattttcgcttcggaacgtcaccttggctccaaacctcagaaccactctttcgtcctcttccaaccagtgtgtccgtacttcacatgatagcagtgcctagtcgttaagttgtgcattaattagtgccaggcacacggggtagtgattagtgggtggctagagtttgtgggacagcgacggagatggcgacggagatggcgacggagatggcgacggagacggggattgcgacaacgacagcgacagcgacaaggccccctttcatgtccattacataagcacaacctctgcttcaatcgtcctcaattcgctatttcggtgcatcttcaagttggagcttttggttctgcttgaactttgatccttttgcttttttcttgaactctgcaccttagactcaacgtttctttgtacaccaatgcggcaacagtagggactatcccgtagatcgagggctacaagatcgtcgtacgcgaccgagaggctcgctgtgtatataagctgtggccctcctctgggtagagtcgacacgatacgcacacgttcgacatattggcatccaagacacagtgagtactatgttgagaggtgcgacgttgttgggagagttggtggagcagagaagaagacgtaagagagtgacaagaatgacgacattttttcgggaaatgacagcgactcagagtcagtcacagccacagccacagccacagccacagtcacagtcacactggcgactacacatacgacaactgctacgacacgccaataccacctgttgagactcggcttggagacccaaaacagtcctacagccttacagtaaccacgctgcactctgcaagactcgctctgagttaaatccaatctcttgtcttgtctcactgcgaacgcttcatttcccaatatcatgcaccggtccagctacgcaccgcgcctagggctttgtgtggtatgcaggcttgagaatattatcatggagcgccggtaagggtccgcccgctgtattttttcgcccaagtttctcagaatcctgtcgctatacatgtaccaccgtttgtctgcggtttccggttccaatctaacacagatgactgcccccgctgtaacgctgacaatggagtggctcttctgcgccattgcgctcctgtcggtcggcgcccgactctacgtgcgatattacgtggccaagctgcgaacccaggtcgaagattggttcgtcatcatcggcgccttattattcatcgtgtgggtcagttgcgacacctactcggcgtcccagggcttcatggacaacaacaagtcataccttgacggctccatttccgaccagatccatggccccgacagcaaccgggtcaaggtcctcaaggtggtctacgcctcggccatcccctactacatcaacctgtggatggtcaagtttgccctgctgggcttctactaccgactggtcccccgaggaggctacctccgatacttcttgtggctcaccatcattgtctgcgtggtcatgattttcgtggttgtcttcctcaacctgttcctgtgtcaccccatctcgctcaattgggctctcgaccagcagtacggagcacccggcacgtgttactcgtccacagcagtgaagcccttcgtggtctcggtcgtgaccaacctcatcaccgacattgccattttcgtcattcccttcccccttcttccccagcttcagcttgccggtaagcagaagctcgcgctttgcgtcaccttctctctcggagccatcactatcatcgtctgcatcgcccgagccgtggctattgccgtctccggcaacattgctcaggttgccattctcacggcctttgagtgttccaccgccatgctcgtcgcctccatgcctgccatgcgagtgctgctcaagcagactgtgcgaaaggcctccaactcacagtcgcattctcggtccaacggctctcgtcctggtacggcaggctccggaaccagcgaaaagaagaacaactggtttggtcttcgaactcgaacctttgccgagaagactactgcttccgagttctctcaggatctcgagatgagcgcacaccgatactcgggcccctccgatgtcgataacacctactacgacgacggagagaccaaggacttctcgccagactcgtccgtcaccaaggacgagcctcgagtcagcattttcgccatggaagacgagtacctgcatcctcaacagactcagacccaagaggtcgagtacgcccgacaggttgctcagcggttcgaggatcctctgcagtcgtcatcaagcgagcactcacgacactcggaggagctcacagacgcctaccccgagcccactgagcatcagacccagatccagcggttgcaacaacaacaggccgccatgcagcagcgtggatacgtgcattcttatggagcccaggacgagtacattgagacgtacatgaaccactccaaccagttttagatggagttttatttattagtaatgtataatatgagcaaacagagcctttgcagagagtcgtacgagtacattacttgaaccactaccagtacactatgtacactgttacaatacatactgtcattgttgacctcgtatagatgtttgtcgcagactaagtgcttgttttgttttcatatctacaactacggcaactgtactcgtattgtatccataccggcatagtaaataataatcatatgcggtattttgcacttgtaaataagtaccgccgaaactacaatacttggatcacgcaatccacatcaatcctcggcctctgaaggttcaatatcaccaattgacacgataataacgtcagattacatgtgtttcacagctccgggtctacctttttgagtccaggggtacatgtaaaacctctaagatacacacggtccgcttggtgtatgtctcagacttgcattatggtgatggtgtcagtcagcaatggtggaggagtgcgataaagagggatgagagtcgtagtactgccattagtatgaatatttggtctctccgtaccatattacctgttcatttggtgtgatagattgataacagagtggattcaaacaataatgtccgagtctgacccacacagccgtctgtttgcctgcgtggagaaaaagcaaccattagtatataatattgtgaggtagtcagcaaataagacattggcaaccgcgccataccgcgctgaaacgcatataataaacagctgggcttagcgcgtacattttgtattcgtgtctggttctcgaaatgaagaggtggatgtggtaagtcgagaagcggcttggaggggtgtttgaaggaacaattccaagtgaggaagatgtgtatagaatgagaaatgcgatatgtgatatttgggtgctcttttacttgaatgtgatgctctggtgttggatattctggtgttgttgccctgtttttttttgttttttttttggaaacaacaaaaaaagaaaaaaagaagaagaaaaaaagaagaaacgtatgtgaaatttccgggagtaaacaacttccttcgagatacgaaggaatgggccacacataatcatcagtcttccacatgtttgtcatcgaattctcacggtactcacacagcctgttaatacagcattcctatatttcagttgttgctttttcatacgaataaattaggtcggcacggcgaaacacgctggtttcagacacacggttgagaattgtaagctcacatgccggcgcgtttctgtgaatatgagcagatttgtagctcgtaggcagatttgtagctcgtaggcagatttgtagctcgtaggcagatttgtagctcttgggaagattcatggcacgtggcgaggaccaggcggccctggacaccctcacggaccccagaatctccaccagcaacccggcagtaaacgctcttcaggatattctccaagagaggtgttctgagcaccataaacaacggtgatggcaacatcccttggaagtggctggtagggttcgagctggtgagcttggagctgcccaattggtgtgaaaactcttttgatcattgtcgtatcagcggttttgttgtcatttccgtgctgaaaacctggccagagtttcttgctgtttgctggaatcattgacttcatctagagccttcctctggacgtcactgatgactcgataccgcccacaatccacttccgcagcacaaaccatcattcccctggagtcatcaacaagaaacaacttcccaaagttgtcttcaatcgagtagtatccatgctcatgagctccgactttgtagctaggatacccaaactgatatccgctgataaattcctccatgacaggttcgtgatccgttatactctccaaagagatccgcacagaagtgtacgactcttcgtcaaagaacagaagaagtccatcataacaagtgaattgaaaccgaggagcatgaccctgtttcatgagtatggcgccgttgttcacgtacatgatcccaggctgatcattgtcaaaatagggatcctcggaaaagcccagaaagacatgtcgtcctagaacgtgacaatagatatcttccgaggcctgaatcacgcgccttatgtctggatgtgtgcctttggaccccttatacttgatcagaacgtgacattccgctccttctagcatgaatatgaacaccaccacatgcggaaacgacacgagtttgtggatgctcaagtggttggccatcaagctgtaagcagacaaatcaagcctgatcccatatttgctggtgaacactttcccgtctgcttctagtttaagcgagtccacaagttcaggtctggtgacaatggtcaaggaccttccaaactcctcagcgtccacttttcgaattggacgcgcgaatttcgatcccacctgccgacgtcgacaatactcgatcgcacactctctccacgtgttgcgatgcgaaaactggggctcgaaccaaggacacacctcctgtagtttggatctgaacacactgtcggaaagaaccctgctccacgatttgctagactgcgataaagcacacacagaacgaatatctagctggtctgcgatgagctcaactagttctggaggtagcattgtgtgtttcgactcgaacgcgactcgaacgggtatcacttgggcagaggaggaaaagtgtgtaggtgcataggttcaaatcttggagatgggaaatagtaatacagtaattaagggcagggaatcttacaaaaaatccgctataaaaacggttgaaaatatacctcaacatttattggcctcgtttgaatggccagtcaaagattattaaatacaggggtggacctttttcgagaccactatcactgacctcccttacggtagatatccgagatcagcttttctcgtctctcgctatcactgaacagtgcatggaccaagctcaccaactcatcagccgagtagtcaaccagagcatcactctccagcaagtatcgaatgtcggccaggttggactccaaaatctgacccaggtactcaaacttgagccagttctgacagaaagtggcggtcagagcctcaccaaacaacgactcaacaccagccgaaatcacagcaacaagtttggcgagttcttgactctcggcctcagaaacgtcgccaagattctcgacctcggtgacgatggttgtggcagcacagttgagcagggtgcccaacatctgcattcgggcgttgtcgctcacttggtcctcccactcgtccgaaagctgagtgaggtaggatgtgagcttctcggcagcagcctggcagttgaacaggttgccgccttcatgcgaacaattctggaatccgccagcaccgttcaaaatgtcggtaatgtggctctggtgctgttcaagtacctggcgcaaatgccgctttccaaatttgtccatcagctcaagctcggcagcaagttcagcttcatccttttgggctcgaatatgattgttgatggtttcaatgtcgttataaagcgccaaaggagacttggctgatcgatacgccagtggaacgagagctcgatagagggcgtaaaagtttgcggtctgagaaggatacatgaaaccagcggatccaattttcaacttctttcgctcctcatacaaatgacttccctcgttcaagaaggaggtgattgtggaagtgagaatctcaggaaggttagtagttataatagcaacgtccgcaggagtagcagtagtggtggcttcgacagtcacatcgccttcattgtcgtcaatgacaacatcagtctcatccccccatccccagtcctcgtttgactcagctgttgactcagcggcaaccgactttgcctcctcggccgtttcctcggtaatgggctcgtcccaaccccagtcctccttggtctccttctcctcgtcactgaactcaaggtcatcgtctccccagttgtcagcagagccctcagagggagccagagaggcctgggattgcgactttcgcacctgcctcgagcctgtggtggaatgtgacgcagtcctgggtttcttggggctttcctgggctttggaaggaggtctaggggtcgtcttcttctcgtcagaaatgttttcgacagctccagacaacagcctagtccgcagctcagcaagaaacttgtctttacgcgcagacagccacacctcgggaagagagaagctccaatcggtgatctcgtctccagacagccagccaaaagaggtcaacttctcctccagagtctcaaggagatcaagatgtgcctcaaaggcaggaagaccgtcgacagaatcgggaataagcttgccgagactctgcaaaagcttgttggtcacgggggtggagagtcttttaataacaggagcagacacgtctttaggaagagtgttaatgactgtaacaagagcaatcagagagtcggaaaattgaggaagtgtcgaacaggcctcgggtgcgattgagacacgcgattgactgtcgctcttcacctgcacctgcagatccagtaacctctcaaacactccatccagagacttgaccagctgacccagagacttcttctgaacaccgtcaccgattgatcccagtagttgaaattcggttccagcgtcatctcccacagccacctgcgtctgggtgacctccacggccttgctccatttggccatctgctcctcctcaatttgggcgaacagattgtcagcttcggaagacagagcacggacgattttgacctccgaatattgcttcatctgtccaatggccttggtgagctccttatgggcctccagcgccttctgtgtctcttgctgctccacatgctgtcgcagaacactgagcttttctctgcacaccttgagttctctcaagacggccagtttcacctgcgtgaccttgtaatcgttgagcagcttgacctgctggatgctgggctcgcctcgatgcaccttggccgcctccacgtatcgtttggtggctacttggagctcctgtcgcgatttggcgtgtgcggttcgaaccgactgcaaaatgtcgcccagagtgttgtcgttttcaaacacgttgagtttctcaattgcctcggcgtcgggctctttgccagacaccacgagactgctgaacgagtcggccacgagcgacatgatgtgatgttcagatggttgtataaagctccagcttgtcacgatgcacagcaactctatcagcgtgggcaacttgatcggggtagagtttgcttagtaagcgaggagggtgatggaagtgaaaagtgacaagaagtgagacgaagtgagaaaaaggtgggaggagccttttgagaaatgagcgtgccttgaagatttactttgtgtatggatttgaattgattaggaagttgctatgttcaatttggagtctctctgcagagcagtccccctaaacttgtccattttccatctgacatgaacatgttgatctgtttgtcgtatgatccgaacacctcgggagttgtttccaagatggggttggagatggtcatgtctgttgcaggcatgtctcccttccgaagagctgtaactaaccacccaggaaacggcttatcatgactggcgtgagccgaagactgcgaattctctgaaaaggtgtggtatccacccatagtcagccctttgcccaccattagtccgaattcgtccgtcaaagatgttctgtatttttccagacggtttaccgacaactttggtgataactttgccataatcgcccaaaacagtccacgaaagcagactcagcagcttgtcctcgtcgatgttgaggttccagaggttgccattgttttgaatgtcaggaacctgcggatagccaaagtacaagtacattatttactgcacccaaagtccacggtcccccagaagcagaagacgtgtaaccgatagactgtagtagtcccgtcggagtggttgagtcctgatttcaatcatcaaaggccttcaccaccccggctgaaacaatcatcgatctgcagtcacctcctgaaaaccccagagtcaaattggaggtacggtctctgttggacatgattcctcgacatctagatctccgccacgttttgcaagaatctcttctcttcagggaaagactcgatttctgcagcttggcagcgataaacgcggtttctgaactcgacatgttttctccttgtcgtggaagcgtaccattaggacacttgatcttgtagggagtatctccggacagtattgtatgtactgcagctagttgatatcgtacatgtggtttagttcttctggggactctgggatagtaccagtgtgatattcacgtagcaaataatagcacgtactcgcactcgcactgtactcatacgaaccaccactatacactgctctaatcatagcaatctaccctatgatcttcacattcggtacgaacgattaacactgaggggtaattctcgagaaaaaccaccaaatgatccaaatgatccaaatgaacccgttggagacgtctttcgcccccgtttgactgtcttcacgtgttgtatgttgtaatgtggataccgtctacagtacttcttgtatttgtacatccacccctccgtaattcaagtcaaccggtaaatgagcatcaatcttctccgacaagaacctcggctccgagactgctgatttgaaatcgggtttcaatcactccatttggtcatattgcatccaatgcccgcttcccggctcgcaaacatctccatctgtttggcgctatggacataaccccaaagcctaaataggagagttttgggcctggtgcagctctcaagcaaaggcggtggaccaagctgaggggagtccgaagactcgtgcgctaggggagggggttttggggagattgggggaggaaatgaggcaaaaaagcgccctatctctccaaattacgtccatttctcccactttcccgtttttccgccttttccagcttcccttagtcgactctgttccgcccttctacactcgctcatgtcccacttttttcctgtgcagaataaccgttttatgcgcagtggcggcattattcgggagcaaccagagaaggcaataatggggctggaaggaaacgggaaacggcaattggctggatttttggtcccgaatacaattgcctttttcaaaatgtccaaaattgcctcccacagcgactacacactccacatgggctgccttgctgccactcgctctgtcaaaaaccttgcggcgtaggctttatcggcctcccccacattcacagacaaaaccttgagtcccacacagttgggccgaggcagctgaactctggggtatacttatacatacagaggcacatcgcagtctgtcactcagtcacgcaaagacactcacaaacaacaaacaacaaacaacaatatgcctctcgattactccgcttatgaccagttcaagatctcgttccccgccgagtgggtggcgctggtcgagaccaaccgacccaagtctctcaactcgtacaacctcaagacgtgggagcagtttggccagattttcatccagatgagcgacgatagcgacatccgatgcattgtgtttggcggcgagggccgagccttctgctcgggtctggatatcaaggaaatgggctcgtttggagccgatgacgacgatatggaggctgctcgaaaggccatcaagttccgacgattcatcaccgacttccaggacaacatcaagcagccccatctgtgccgaaagcccatcattgccgtgtgccacggaatctccttcggtctggccctcgacatgatttccggcatggacattcgaatcgcctccaaggacgtcaagttctccatcaaggaggccgacattggtctggccgccgacatgggcactctgcagcgactgcccaaggtggtcaacaacctcggatggatcaaggagctcgcctacactgcccgaatctttggcgccgaggaggccttcacccagggtctggttacccacgtggttgaggacaaggctgccggcatgaagaaggccctcgagatggctgttctcatctccgagaagtcccccgtggctgtccagggatccaaggagaccatcaactacgccattgaccacaccattgaagacggtctggcccagattgcaaacttcaacacttatgctgttgctggcgacaccatcgaggctgccatgagcatggccatgaagaagaagcctacttacgagaagttgtgagcagagtgggcgaatatattgaatgaatttattgatcactttcgagtgggagcacagcacaacacaatacatactgtacactactacctgttatgtatgtcgagcagttgtgtgagaagagctagcacaaccatcgttcggactctcttgactttttagatggttgtagtgagtcagaatgtgtctctactgccgatgaactaccgtcaaaggagaggtctagattgagtaagtacgagcacagtacatactctactcgtattcaatagatcctcactagaatcgggatgttcattcaacgttaacaattgttctttacttgagagttagctgttgagaagccataatgttagtcgaaaccagaccgggccttctccagcttgacctttacatcatctgccgcgacccagccggttcgaacttcataccctccatctcccttagtgcagaaaactggctggatagttccgttgtcaagtccctcttgacgcccaatcttgtacttcttcatgcgcaaatgcttaggatctgtcatgaacttggctgaccattctccagatgacgcatgtttagtgtagaaggagttgtagaaacgctcaaacttgatatctgttttgatacagtcgagttccgcgtcaaagttgtccaggttcacatacttccatgccttcttgagattggcacccctgaacccctgctcaatggcgttgggaagagggtagcccgcgttgagatatttctcagtcatttgaaacggaaaattgaggttcttgtagttttcgcccgtgggtcggtcgtacgctacccactgaaacacgtaggggacgactatctcgacatgcctggaaatggcgttgaggagcttctggttggttgaaagagagtactttctgtcggtgacggggtccacaatgacaactgtggtgttgctagtgtcagaaaagttggccttcaaccagtcggtaatcgcagcagtgccgttagagacgtaggaaacaggcaggggctctccgtcagccgggaaacagactgccacagtcttctttttgtgctccagcactctgaagtagaagatgtttttcctgttgtatttcgcttgggtcattgtatcgtaatggagagccgaacgggttctccacaggcatatatatactcctccacatcaggtgtacatctgcatggttggggctgaaactaaagaggggtagcaaaggcggatgagaatgagatgccggatggttggtggtgataccagatggattgttatgatactagatggatcgttatcatacaaggtggtcctttatgagccactttgaagagcagacatctggtttgtgggtggttgacaagattctttttctagcctggttgttctccacaccagaacagccccaaatgcacgtgaacagccccaagagtccaggaatggggaaacaacatgccaattgttcatttcgttgggtaaatcaaccagaattgattctctagttgctgctattgacccaacttcttgccagaacatcgccagatgaagacccaaaagctgagacatccgaagataccatcaacgacacagttccgggctgactcctccgatgggttgttggccagagcaaattcccacatgagtcttgttaatactcactgaacacctcccctttggctctttttggctctttttggctctttttggcttcctttggctccccttggcttctagagagcaatacctttcgaatatggtgctttgcggttcaaacatcagacccgaatcgagaacatctcttggactgaacaacaacaataccggttgttacacaacaacaaggagttgaatctgtatctgaaatccaagatcaactctcagtattggtaagccatgagataatctatggaacgacagattatgctccctcgtcaaggcgtccatatcctgctcttacatataacagaagcattcccacgttctcattccccattcctactatggatctttcagagttcgaccgcttcctatctcccgagggagaaatcctgctccaccctgaggagctcgttgatgctcttctttctttgtttctgagcaacgccaatctcaacatcacagtcaaagtggagtcccttcagttcccggggcgtttccatcatctcactttcaagcgactctatcagtcttccgagtctcctccgctagaaatgaccatgtcgcagcgtctgggggagcagcgagacgaaatgatggattctatcgaggcagaatgggatcatctgagtgacttggactcagacacggaggtgttctatccagatgcttttgaaatcgttcgtcgtaatccgttcgttatcactgagggatttccaacaacaaccgagggagcgtcctttgatgaattttgagagacgtgatctctatgatggttcattggtaaggtcaaaggagaaagggagttgtgtataaactggcagatagttgcaagaactaaatatgaccctatttatgtgtgttactatagtgcttacgaatatcccgatcccagattctcttcaactatccccaatgtgcatgctagacactcctgtcaatggcataaacgtggcgatgcggttgattactaagacaaaaagagtagaccataccaaacaatacaaaactcgaaactaccaaccgcgccgccaatacgactagtcacgtggctgagactaagtcacccacgcttcgacttgatcagcagctcccaaactcctcaagctgtcctgactgcagctcatctcgacccaccaataaactttgactacgcatctttcaacattgaaatttcactcggatacaagcaacacaatcatgtcacagggactgacggcttaccgaaacgttttgcgagcggccaacctggcgttcaagagtgagtacagttgcggcaacaacgactgccaagggaaacccgtgccccgacagaccctaacccagatgatcactttgtgctaggacaggccaaggccaacattcgaaagggctttgaggacggccgaaagctggatcccaaggacgaggacgtcaaggtgcgtctggagcatatcaacggcgtggcctacgtgctgcgaacacaggtggtccagggccagaagcacaaccctgatgaggagaagtaccagctcaatctgcacaaggactccgagatgggagacaatgagtccatcaagagccctcctcccatgcccaccaagggcaagaagggcaagaaggtcaagtgctgctccgagtagatatgtatatagttgtatgatgtgagttgagagtagagagagttgagtgtgttgtaggcttgtggatccgagttgtagatggaatcatctggagctgtgggaaccttgatagttgagttgatcattctacgttgtattgtagttgagcatacatgctgatagtcaaaggatagaggagtatcacagcaatagttgagtatggtacgaactggcttcctgttctgtacctgcatctacagaacttgtcttgattgttatcatggcagtggcttcactaggtaacattattctctacttcgtcgtactaacctttccgtatctctacacatgggcatgcctacatcctcaaacaaagtataatacattatcaatctcctcattttcatcttctctcattactccccttggtcatcctcgtggtcgttcccattacttcttcttcaagaaccctttatccttctttttgtccttcttgggcatgtacttgtccttgtagatccaatgattgcccacaatgaccacgccccgatcctccgcctgtctgtacagctccgccgcccgatgcaaatttttcttacgaccgttgcctccattcttcatccaaatgttggccgcctcacacagcgcgtctccgtctccaagtgtgccagccaactcgaagtactgcaatgccgaatcctcgtccttgccggcgccccacgaatgcaaatagctcatccccagctcgtacaaagccagccccacccgtgacttcttcacgttggacgtacccgagcctcctgtgacagtatctgccttgcctagagtcttgagcagatctgccgtcgacgaacggttgcccttgtcgttaccggcatcgaaaaaaatgttggttgcccgcttgagccacttgacggcctcctcggggttctgtcgcaggccccatccgtgtcgtagagctagaccatacagtagcatggcagtcggctctcccatattggcagccgtctggaactggtacgcactctcacgcagcttgccatgctcgtggaaagtgattccagcggaaagatgctcgtctgcggtggccgagttggaaggaagaggaatggtagctgaagaagcatttccaacacctccaaccgggccccctgcactaggagtaggagcactgttagtattgctcaccgtgtgtgtagagggcgtcagagaccgcatggaaccgttggaggggactctggtatgctgttgatgctgctgttgaacccgcggaggcacaggagacgaaggtaatggcttgtctgcaaatgcaggagggagcggtttgtcggcaacaggagccgtgaatctggtctgctgaacttgcggctgtttgaccaaatcctcatctagctcatcatcgtcgtcatcatcgataattcgaggtttatgatctctgtagtagttttcaaactcggaccgatgctcctctaaggtcagttcccgctgttgaacagtgtctgctgaatgtatactggctgtgtcgtttgtatacgtctgagcgagtggggtgtcatcctcctcgtcttcatcctcctcatcttcgtcctcctcgtccacctttagtgacatgagtaagcctccaatactgctgtttgtgctgatgatggacgtttgtctgtggttgtaggagaagtcctgcgagtcgcgcgacactatagacgaggccgacgatgtccttcgcgggttccattctccatattgattgtatccaaactgatctgtcactcctcccatagtttcggttgattcgatcgaggtgatcgaggcgttggagggcagaacgtccgagtccagtcgcttggacattttgttggtctttttggacaatatgtccaacggcgagagattgttgaagtccattcttgggtctgttggagagaatggacggttgatttggttggggacgtgggtttttggttttggtggttttggtggtgcacttgggtcgattctactggtgcaaaactctcgaggtgtcgttgtctctgcttatctgctcccgcgcactcggctgcgtgttcgaccggtgctccaagggctgtagtccgctggtgaaaggtgtggactggtgtatggtcgcgtaccccttctttctccgcgtcacccaacttgtggaacctaaaaaaagactaacgtctggaccacatgtgatgtcaccatacatataggggtgcatgagggtgaggagaagggagcgttttggggccggtaaagaatgatttgtcggagaaagtgggtccttatatacacaaacaaaacgtctgttcaaaatcccacttgccctcctcctcaccacaccacacggcacacactagtgtgtctcaaacacccgctcacgcactcgctgcaaactacgagaggcagccaacaggcatacttttaccacgagccatgtctgctgatactttttcaaatgccaaattccatagagctgagagcataagcggacgagagtgcaaacgctacctccgatacaattctatggagagcaaagatacgtgatccaaaaatatcccgacattacgtgtacaagtggagcatctacgagacgcagcagaccaaccggttctagcacggaatgagacggcaacactctcactctcacatccttgtgcggtctatgcactgacgcggatggcacaggcgcgaagcgaacatctccctcgtttatttgctcggccttcgagtacgtatttgtatgaatttctacgaatacgcatgagtactcggaaactcggaattatggaaatgcagagcaaaacgaccatacactatgtatttctgagctgggttctgaaacacgagactacgagatctacccgtcgcatggttagggttggggagggagggttagagatggctctcagtacgagtacagtgagtacagtgagtacagtacgagaacaaccctatcggaccccacttatcatacacatgtgcaattaagcaagctgtggttactgtatcttgaaagatatcattttcgttcagatggtgtgtgtgggtgtgacatcattgtgccgttctcttatggcccgtccgtcgtatcgccgtttgttgaactcactttgacactgcttttcggggcacgtccgtggatgaagttttggtgggattcccgattcgccatagctataagtattgcacgtacaggcgatggagatctttacgagaatcaaagtgtagagatcgaagggtgatgttatgctgagaggtatgcgattttttggtcataattgccctgctggggaggctgtcgagaaggcttctgacgcttctactgaagccctgctgaagccctgctgaagctgctattgctgaagctgctattactgcagatgctgctcctgctgacgatgatgacggcgatgaggatctgtctgatcttgagaaggatgggatcaagaacgctgctgttggagattacgacgacgactagaacaagatgagcgcccaccgacatgggtgcagagctcaggcaagaagatactccagaagtgagccaccaagggctcgagggccgcgtcgatcccagcctcaatctcccgtcgtccatatgtgagtgatcgatctcgtcctcatcgtcgtcccacagggattgtgttgttcttgttcccctattatttcttttttcggcgcaacagcgggtttttgctatggaggactggcgatggagaaaaaggagaaagagaagacattgctggttggcctcctctgtgttccgcgtgtgttagagacctggaatagaggcctagaagctacagtatcttcccatgagtatcatatgtccacaattacgagcaccctaaccatcatcattgcgcattgtcatcctgttggtctgctgttcaaaaacggtcaaaaaagtacactgctaccgaaaggcagcgaaattgaatatttgacgagtaatgggcggctttgaggtacctactgtaacccgggacagtccctcaaactagtactactgcaaagacatggttacatttctcctagctatgatctcaaccaccccaagagcaccaatcaaagtcaattaatttacatatactttagttgactcttccagatgatttgatgggtcctgaatgaccaccaaaacacggaagagcagcggacaaggctctaatggttcagagccttgtcaaaggttgcttggagggagttagcaagtacggaacggtacagctccgagtacttgtacatgttcgagtaagtcttggagttctgattctggcagatctatgattatgtacatgctctcacactccaacagcccaatgttgctgtacctgtactcgtactgtactgtaccaataaaatcagttgacacacacactgagatctatccttcctacagcctcttatgaacctcatcctcagcacactctttcagccctgacgacaaccttgaaccttgtctactacatacccagtagaactgaagacctattacaaagcatctcagacaccaataaataaatggcgattcattaatcaattcaaatgtctcattggactgactctataccctcgtatccgcctaaaccgccttgtatcagctttgcactgcgtcatcgtcggacgcactctccactttggcctgtcgcgagatcaaagcctgagtaaccactccactacttgtacatactactctccaccagatgtgcaagctggttcacgtgttgctcgagcccacgtacaagtacagcatatccggaccatgcgaatctctcgtaccctaggctgtcccaaataaatcactcacataatacctctccacccaaccactgtccgttctccacggaatacctaatagccgcgagggcaaactgagacaaagcgtggatgggcgcatgaatggaagggcggaagtgcgcatccgaaggtccatccgaagcgggctccaaaaaaatttaaaaaaagaccacatgagtaccgcaaaacgggacgttgacgaatttgccagaggcaccagaggtgcatctcttgatacatgtttttttcactcgacaggtcaaacgcaccgttgaatggaacgtcttggcaaacatgtagcgagcaccgcaggcgtcccagctatagcgcacacaatagtccatggtgcatggaacccagctggatcgtcgcttatcttcatcagattgggccatgtctgttcatttatgatttcatttttgcattgttggctgaaaaacgttggggtctagctcccaggccggccccagttggccagacaatagactttcagcggtgctcaaaacaactcaggaccctaacccaaatgactctctcacgtgatgatagtcatggagactcggtaggcttgagtcacctgcataattgctccgacaaaaacacaacctccaagccgcgctatgaaatgacggaaaatcacgataatgaacacggagctgccacccggctctcgtccccgttttccaagtccaccaagctgccgtccatgctccacgccatctccaaaacgcccgcagactcgccactgagtgaagaaacaaacacaagcataactgctacgagcgggactgaagaaaagaccactagcgacgacaatgccgcggaaggaccggtcacagccacaaacgcgtctgccgccagcgtggccccggataaccaacccacaggctcgagttttacgccgcaaaatgccaaaccaaccacccctctggcttcgaaacaaacacaagcacagcccaccagcccggacaacacggaggacaagaagaagggcggagtgacgcagagcatcagggagaagctcaacttccaggacgaaaagctgtggaaacgcttctccagccgccgtctggatctcattgattccatggccctgtcgtccaaaaaggccagtgaacaggacgtggaaatctccaatgtggcaaacacgttgcgcgaggagtacggctatcctcccgagacggctgcagattttgatcgactagttcgagcaggaatccagtctgtgcgacgaaacaggaaacgagtgccacggttcaagcgaagctcccatgtcgtttcccagggccatcaccctcaacgagtcaatttcctggccgcaatggccggacctatgcatccccatcatggttcgcctgcccacgccgcagataacggtcacaatggagttgccacccctcctccagccatgtcacccgtgaaacgtcaccggtctgaagaagacgcatcggtggccctgcagagcctgcgctaccagcagcaggcccacggcccaacgacgctgccatcagtcacgtcattgagtctcgggatccctgccgagcacttaaaaatcgcttgcgatcggtttctgtcattcgtcgctcgctcgcattctggaaaggagcctccttcgtccaatttggaagctttaggacgaggtgtgctggaatccgcagtcgccttcatgctggagcgtcaccagcccaaagacaagcacgatagcttgcgggagaagctgctttccgagcctaccaccgcacacgtggttcagaccctgaacctgcgcccccaacctgcccccgggacatcctctgcgtctcccttcttccataacctcattggaggttgtgccaaggactttggatttgatgcaattgtgcatgctctgggaaacatttacctcgagctagtccctcagtacgtgggacccgtggctggacgagcaccagtgacatctcacactccccactctgcacctcctccacgatatggacccaccctgcctgggtacaagtcagtgacgtttcggttcatggacaagaaaatggactttagtttctctgtgaacgagaccccgccaactttgtacgagctgctcgagaacggcatcaagactttccatatcatggtggaggacaaggtgctgcacattcgcagccacgaggatcgggagctggtcaagtccgactacgacgtaaaaatggtcttttctcgaccttccgtggatgtggagttcttctttcctcttctgcctacgcccaacgctacgaacatgcgttatatggattctccgtcgtttcagaagttactctagacatcaagagcctccttccaagttactttttacaaatagccggggccttatgtcgttctttacagttacccaaccaggaaagtgttatagcacggctctggctgtggatgcctgttttggtctgacgtgcgcctttgcagcattgatccgttcaccacaatgaaacctcatccaaaaacttcactccaaaaaataataatttggtgggtccatatctttccccagccttcctgggctcggagcgacttttgcatcctatttatttggtctgtgtccccaccatatcagaccctcatcatttctctcacacaacacttacaatactacaatgatgttcatgagcctagtttctcttgctctgctggttgtggctgctccagtgactacctctcccgaagcccctgctgaccagattctggtcgtgtcacccgccgacctcaatgttcaaggaactgatattgtctatcggcctactgttggcgcttcggaccccgactatcgtcccgatctgagcatcaacgtggctaacggccgtgtggaaatcgacattgccggaacccccacgaatgccaccttgcatacctcctccaatggacattttggctacgctccggtcggacagacggctctgaagtggtctcaggacggctccgctgccaccttgacctacaatggttccccctacttttacgcttgtgtcgagggatctgagcagtacatttacgtgcagattcctgacattgccgcccattgtgcttctcctcagtggatgaagattagtgcttagatgtgaatgaattttacgacttgagtgtgccagtaatctccaaagaacgaatgttaatgaatctattatgcaatttagttttatatatatatacaagtgtctgtttttgtgagtatggttgtgtttggtggctacactaccaccatggtatacttgtgtttcttcatggcgttatgcgagtaggtgccccaggtgacgctctgcgggagagttgtacatcggataaacgtagctatcgggcactgggcgacgatatggccctttctcttgcatttgatgcagcagttatctccggtgacaaagtgggctcggatgggactggagtttctgctttctttgccccaggcaggatcgacgttgaacagcagatcgaatctgtatcccagcgaggccacgtttctgaactccaccttgacagcgatcacgttggttgtcagctccttgtgattcttatgcgtgtagactcggtagtttcggtctagagtgatcccctcgtcaaaggcctggaactccttttcaagtccaaacagccatggattcaggcgagaggcactgctcttgtcaaacggatcaaaccagtctggagcgtacatgaagtacagcgatcgagaaacctcagctttcatggacggccggaaaaaatctttagctgccattttggccacccagaattgcgtgggtttgcgggatttcggatcgggagcccttggacgcttattattgatcatatcaaggtctggaatacggcaggtggggaaaaagatgtcgtcttcgtcactgtccgtctcatagtagctgcttccgctgtcactgtcgctctcctcgctctccaacgaagatgtgtggctgtcgttatggtggctgggatgcagagcgggcggaacagcgtcgctgatggtgagttggtcgtgtgtatcctcattccttctcatgccgtgcctttgttgtatctggtggaaagaatcgagcttctaaaagttcctgaaaagttcatgtacatgcgatatgctaggttagggttggtcaggtggatttgagatgcctttgttgggcaaagtagctggcggattcggatggaaacagtctaggggttttcatagtccttgtaattttcgatttattgcttttccgtacatttttttcgccaaaaacccccattgattaacacctctagctccctcaaccatcatccgaaactcatcacctcccggtggccaagctggtttaaggcgcgagactgtaatggaatcaattgtaatcttgagatcgggcgttcgactcgcccccgggagatggtactgatcactctgtgatcgacttcttttttcgatccgctttttgcatgtcatccttacagcgtcacctaccaatccaaactaaatgtgtgtgaagataccgctgatgtcttcactcagagcatcagcgaaaagttttccgtggcctaaagcagtgacataatccaccccaatcactttgatagatgttgtacatctgcttatcacgtcagctccaactaatgtcaattttcgccggctagttaggctactcaacaccttccatagctcctacccactcggaaataccaattcgcctggctagctcaatcggtagagcgtgagactcttattcaaagcaatctcaaggctgtgggttcaagccccacgtcgggctgaagtaactatctcacagagtggttgtacttttttttgattacgtgagccgaaacggagctacgaagttgtattttcccggacaaacacactaacaatgtgtgttcaacagccagattgtattccgtacatcgatcagttacatacatccatccgttgcaacttcaagtgtgtacttgccctcgtactcgtcttcacatcttctcctttattctttcttctattgtgcagctcatatgcaagattatgcaaggacgataaaagcaatcctatcgctatactacatgtacacacacagcatgttgtacttgtttgtactcgtactctcctcaatttacaaatcccaaagtgttaaataaaatgacgtaatatacatgttcgaatgtcaccattcattgttatcatctgtgttatcatctgcttctgacccgggccagatcctccaagaaactgtcaatggcatctcgctcggccttaacctccataggaacagcagatccatcctcagtctcctcagccaaagtctttcggtactgatccagaccagaaatgttgagtaactcctcgacatccactccagaatgaataatgtcgccaatcaactcggaaacagtgcccacaccggtggcattgagaatcgccttacgcagatcatctccagaaggtcggccagagtgaagaaggggctcgttctctcgaacctgcatcacaaaagttccccacttgtgaaactctccctcctcgagctcctgtcgtcgagcctggatagacgccgacgacgagtttcgggaaagagcgggacgaccttcatccactccctcaacctggagatcaggagccttgatctgaggttcgttgcctgccaggcccatcatgtgagtcagaggatggacggtgggaccctgggtctggggctgctttcgctgcttctcaaagttctgaagagtctcgttcaaagtagcatcgaggaaacagtaacgaacaagcagctccttgtcctcgtaggtcagctcgccgttgtttcgcttggcaaacagctcgtccataaccttctgaacccgagtcttaacgtggtaggcacgctgaagtagcatgtcactaacctggcacgtctcctggttaaactcgagaatatcatcgacagtagaagcaatgtccttacccacgtcaaagatatcccggttgtcttctccgacctcaatctcatggtcaatctcgttttcagaggttgccttgccgtataccaaccgctccatgttgcgcatgcagtaatgcacgattcgtcgctgctccatcttgggtacgagactctgttcaaggtcaagaaggtagatggactttgaaacccgaacggctacagtcagagctgccacacaagttcggtccatgcgcgtgtttccaacaagggaaacatgcagaagcgacttacattgcgccaaagcgtctgaaatctgcaccacatcacgagggctcaagtcgcagtaatcgagatgaattcggcgcaaatctgggaaaagcggtagagctttacacagatgagtcgtaagggagggaaagagtccagagttagaagagagatctaaaaaccggagattctgcagcttggaaagggcagtgatgagcttttcggtcgtgggagaggcctcgaggtgcgtggagttcagggaaaggaaccgcaggttcagctccttgtcggagagtgaatccagaagaacatcaagagcggtaggttcggttgattcggaaacgggcaccttatccttcttctcctccttctcctccttctcctccttctcctccttctcctccttctcccccttctctgtaccttcggctccttcttgtctcacctcctcctcctcctccacgtaagtcagatggttacctccaatatcgagaccctcacactcgccagtcatccattggccaacgaaatgcatctcctcggggcccaaatcgttgaatgctagtccgagacgttttgtatttttgcatgcgcccaacatgagatgctcaaacacctcagaaggcactaaacagccgttgagcacaagttcctccatacctttgccgtactgtagagcatcgcacaacagcttccaatccacagtgggaggggttcgctgcttgagctccttgtccttgtcccgcttcatctgatgcgacaagtccagccgaacaagcttggagttcatggccaacaagtagcacaggcgcttccatgacatctcgtcaatgctagtgtttcgaagagacagcttttcgagccattgcgaagcactcattgccgcaaacaacagtgaaaacatatccggagtgagggtcacattatccagaacaagtgtactgaccggagccacagccacaaagtcggcaaatgactggatctcaatcaacgtgggtctgggattcatcagacgcagggaaagaggcgccttttgggccttgatctgttttagagtagctgggatcggcagaatctctcgcagatgacagcaccgagtatacagtttctctacgtccacatccagcgggttgtcctcgtccgactcgtccttctcgttgtacatttcatgggatgtcttgagaggcgtgtcgataatgaggttggagatagagggcacctcgtcgtcgcccggaggaggagacgttttagtgtctttggtactgtccttggcagtttccttagtaggtgaggggggcttgctgggtgacgccttggctgccaggggagatgcagaccgaggagagccagcaataggagagtttttgggcgagtttcggggcgatcgtttcttggtcagtgagcccgaacgagccagagtgttctccttattgtagaccgacgccttggtgaactccacctccttaccatttcgcatgataacaaacttggaacgtccagaattggatcgtgagagaccagaggtcgtaggcgagggagaaggcgattctcgaggcgaccctacgggtgagcgacccccgaccttctgcatgtctactgtgagatggggttgggacggttttccaagaggagacttgccattgggagaggatgctcgaacaggagcgccggtagggactgtgagggaggagttgttggaagaggtcgatgacgtggacgaagtggaggaagcagaagacgagactccgttggagacagctccagtggaaggtacagcagagactgtggaagtcgcgactgaggagccaccattggaggggattgctgctgctgcggcagaagcagctccagccgtcgcagcagtaggagggcttattttgggagcaacgggctctttggggactgctgctgctgctgctgcgggagcgggtgctgcaggtttgggaactgcaactggagctgcttgggctgccggagaggcagtggcaggcttttgaggggttgttgtctgcgtttgagccgcctgagcaggagctgccgtctgtggggtcttggatgaagtggcaggaggagccgtctttgccgcctgccgtctgggctgtccaacacccgaattgaatgggttgaagtgatgctggtcatggtgctgagggggtgattggatcaccatgccattcttacggagcaaaccatcggcaccaacctctacattacccttcttgggcttccgggcggggatctgctgaggagggtccgaatgatacgtgttgatatcaaacgacactcgacgagaagagacgccctcaagacccgtgagctcacaattccgtcggttactgttcttgttcaaaacacgcgacgtgggacacgacgctacgcctcctgtggagggctgcgacttggagaaccgccgcagagtgttgagaaggaaccccttgggcgatcccacatctgtggatgcagaagaggcgatggacgaggccaccgccggtgaggcgcctgctgcgtggacaggcgggaagggcttctctgggatggcaacggcctcaacattgatacgaggagaggctgtccgagggggtgaagtcgggaggttggcagaggtgggagtagatgcaggagggacggtagtggctcctgtggcagcagcgacaggaggagcgatttctggaatcgtcgttgtggtggtttgtgtcgtgggggcagccttgcctgatagcgatgccgacgtttgctgctccttggatgcaatgggttgtgatttgctgggtttcgagaaaggcgtggctgtagggctctttcctaacgacgacgaggatgcatccttgccatctttagtcttttcgtctttgccagatctccacttgctgaaggagttgagccacgactttttgaagcctggcgactgctccttgttgagcttttcacgctcggacttgaactcgggcgcagaaatggtgcgtgaacgagacaggttggggcttccgacagaggtcttgacgtaggggtccagggaacgggtgttagacaagtcgtgtgaggaggtggagggctccagtgccgtctttgatgcagaggggctggaagatgcaacgtttgtgggagtggtacctggcgacgtggcccgtgaggatgaaagcgaatcagcttcttccttgacatgctggagaccgagagagagctttgacggctggttttgcactgaagaggtggacgaggaccgggctctagttcctgcgttagtacagtactgcatgagtggactgtttgtttaggtcatcgttggcaacgtcattaacagtgtagaagagacgtcatggtgataccatgacactaacagctgttagtatattcaacacctgcgtcctatagtccgcgtgtatcaacgttatcataatagaccaccttatcatcatctcgacacaggtcagtccaacgacggagcgctcatatcctgtgcggcttttttttccccacaaaataggagcacgtttatcggagcacaaaagaatctggatcgagtaggaaagcaacgtggacgattgcgttggcatctttggcgtggactcgtgtttgtgcatcggcaaatcgcatgtttcttattactgactagtgtcaagtcaaatcggacgctgctatcaggtgacctcatagcgacgggggtgatgtgtggtgtctaagacactgttgagggggtgtgtatatcgtggcgacgtttgcgttgtggtgcgtatcgctttttttccgcaacacctaaacacagttggtttgtgtcacgtcatctcgctcgacgtccttctatcagacgtccacagacagccgcccacagatagcccacagtcgacggtgagcacacagacgacaccgacgggggggaggggggagccggcagattgtgtgcacatgtgggacgacctcagccagcggacagtatcacacgagtctcgtcggacccgctgtccagcacgcacgacgttgtccatgtcaccacttttcctcgatcccttcgacgatactcacttttgctgttcagggccggaaccttgccgcgactgagccacgacacttcggtgttgctgacgccgttgatgacggagccgatgctgcttgcgagagtcatttagtcggggtgcggtggtcgtctctcgagatatggctgatgttgaagaagcagcaaatgtgtggagaagaccatctaaacctaaacggcgggtaagacgggaatatcgtgtgggatgcaaccgtatgcgaggtggctgggggttgggggaggagggttggggagggttgaaccggtgagcagagcgcggggagagagcggagaggcccaggcgacgtcgaacggctgtgcggtcggttccgactccgtccacacggctggccactaagtaacctcctaataatctgaccttagcaagcagccattttctgggacactatgcaactttaaccagtagcttgaaagtgaatttggcatttctgaggagtacagtacgacgagcatcagcttagatgtgggaggagctacagtgagtaaaggtgcagtaaagggcggccaagaccaaaagattggcgaaagaagggccaaagattggcgaaagagaaagaccagacctagggttggcgactactcacgacttattctcacgacggtcgttagggttcgtcatctacggcattcagaaacactgtggagctacttggaaggttgcgtcattagacgtagacagcgcatcgagagagggccagattgcccatttaggggcaagagcagccgatttgatgcaaagaaaggaatgagagcgcccggggaccgcgtgacacacgcaggtggcacaaaccagagcaaataggcgctctcctggccggattatcgtctaggggtgattggcgagagtgcgagtgaaattatggatgtttccaccagtacatacgatacttgtactcgcacccatattacagttgtgtggcacaagtaaatacagtattactgtatggcacaagctcccgccgtgggactcggcaaaaagaaacaacaacaggaaattttttttcacttttttccaatctttcaaccgccaatcgttgagccggcagcaaaatggaaggtcacgtgacgcatctggacgcatcgagcgaagccgtgaggggaatgcatggcgtacgagtagcgagtaaggggtagggagcaagtcttgtgtacttgtgtatttgtggagtatgatacgagtattatgtacgatgcttgtatcataggagtacatacagtacttgtagtacgtacgacacttgtgtgataggagtacgacagcagtacgataggagtacatactgtacaagtagccgtacaagacttgtgtcattacttacacccgaagactcctccgaatgaccctatgcaacgtccaatgagctacattgtgccatgactacgaaaggtggaatagaagctcaacgtttcgcttagagtacggaggtgtttcaatatgggcactagacagagaggtggtataagtgagtacgtacgataggagataacatagtgatggtggtacggtagctggaagcgggtagcgatggttggaagcggtagcgatagttgggagccggtagcgatggttggaagcggtagcgatagttggaagcggtagcgatggttggaagcgggtagcagagcttcccccagtcacgtgacgttgctatattgctatggtaacgtgaactcgctctgcaacatgttctccgctcagctgtgccactggttgtttcgccacgtcttgtctcgttggcctcgtcttgttcacctcgtcttgttccgttaccctgctgtcgctatcaacctaccccagatcagccaatagtatcagcacatctcccacagtgcaggtgcatgtgagacgtggctgttcagggtacacttgcatgcaacattaatccgtgggtggcgaggcgtcggggctacgggccgtttctgggcgcggataaacgcgaaaagcgggtaacttgcactggaaaaatattttgtgggtctcccgcggtttttcgcgcttatcgtcgtcgggctacgaggtatttggagacacccctgtgtttgtccttacaactctaactgcacgaccccacaaccttatttgtcacccatattccattagcattatggcttgtttgttacacctgggctagaaaaagtattgtcagagaaatatataagggcggaggaagcccagaaggtgttcactaaccaaccaacgttacagcaccgaccatagtcagcgcaaaaagcacaacacacaaacacagcccgctagaacccacacacagctagaacccacacacagctagaacccacacacagctagaacccacagccagttactagtagaaagcacacacaagacaatggacaagccaatccgtacctcgccccccgtctctccccagttccagacggggtaccccatgccccctgcggttgcgactctggcgcaggtcaacatgccctccacccaggtgctggagcgggccaagaaggagtctctgcactgggaggactttgtcaagttcaacatttttggacagcattgagatgagcatgttgagttgatcttgacctattcatctgctattgttgctggtgtattatttattgctggaggatatagagaatgtattgtttgtaactagagagtagttggagactacgagtgggggagtgggcatgtcggatgtactttaccgcacgtggtacagttgcaattgtagattacgagtaaaagtaagtacacggtactcgaagtcgaactcgacctcaactcgaactcgttgataccgacagtctcatattgaggaatgatcgaaacaagtgcaatggtctcacttggttctctgaaacttgtcggtcattgtcaactaaggaagatcttgttcaatctatggacctgaaattgcatgccacagtatctaccgtactcgtacttgtaccctccctctctgtattcactctcgcaccccagtattccatctcttggcacccctttttgtcttggctcgttgcgaccctgattaatttcccatcgcagcaagatacatacaaagagtgagacctatgtggggcagacgtggacaaagtgggatacaatgcgtacctgtaccagagcggaatgtcgaatggtttgtgggtgggtttgtggaagttgctccgtcttttcctccacctgtggctcctttggttgtgtcacttctccgttggtccggaacaacgctcatttggccacagtagctctggtggcaaatctatctgcttgctgcgtcccatgaagcacgctatcctccggtaccaccgagttaataggttggatagagttgctcaaagggctatcttttagtatcggtttaatctcaaatgtggggtacagtaagttgacgaggctgagcaccgtggaatattaaaaaaaaattaaaggcacatgaaaatatctcggaaaatcgtgtcgtcaaaaaatacgtctccgtctggttgagtgttgcacggaatcaaaatactatcctccgggcttcgctatggaggtcttttcgtctcaatccaacccatataacccctcaacatggctgcactaaatgacgtcacagtcggcggaaaagtctttaatcccgacttgccgatgagacagggtggtgcaagtatagtatgtactacaagtgcttgtagcacctcgtaccgtagcaaacaaacaagcaggtcctaaagagatcgtgctgaaatatcccaagtatactctacttgtacgcgccatctctgtgctacactacagcctccttttgcgaaagttgagcgcaagtctgtctctttgcttgatattgtgtcgaacttgaaaccccctcttctgtcagtcaccctcacttccactcaccccacattccatagctcctatgtgcggtgcacaatcaagggcgcactggtggtcccgataccggttagtctgctatgtaatagatactggctatgaatctggggggttttttttatgaatctggggtatttttctatgaatctaaggatatgctactgtagatactacaagtaatacatactctagctgtagttcatttagtagatgctacaagcagggtataacataacaccagtgcttgtagcttcaagacatactcgtagaggaggtagtgtggtcatgctgcgaccaatacgtaatttcatacgtcatcgtcgaagcagtcttgactacgtagactacttaccgtacaacacgtactcgtacggtatgtacagaacgtcaactctggccggtactcccttccgcaagacaaccctcctggtacttgtacacttccttgcgtgacatcgggccgtcgaacactggagcaccggtgccctgactcggacttctttttcacgctcagatcatcccctcgatcagctggggcatcgagacgttccgggtaacgcgatcaagcatgtctgagttgtttaaggcgtttaagacagacctagttgcgaaccctacaagtgcaacagtggctccttttggtcatgagtctattgtctgttgagacctttagatcgagcccaacaaagcgcgggtcttgtttctgaagttgtcgatcacttttgcttgcatcgtgtctcatgcttgatgtgaaggatctgaacgtgaatggcagttgaaagcacaatggctactgtacaagtacttgtacaagtattgctcacgcttatgattccgtaaagtcaacgtcgctcagaacattcaatcgtttctttttcaacccctgaaaaatttatacaagctgcgcaccctgtatcgcagtatgatatatcatcttcgtttaggacgcataatacaccatcacgagttggccgaaaacgacttactctatgaaaacctgtccaatacgccaccaaaatatatttgtttttagccgccatggcgaaatatctgcttctaaatgcctcagttgctgttattggccccgtctgacatttttccagattgtcacgacccagttaaactcaacctctgaaatacttgagcttatgacctggttacttggaggatcacttgagatcgccgtggttggaaaaaaaatcaaggaaaaatctgtgcggatgcagaagccgagaatcttctcgctgaatgactactgaatacggaaacggtcacctcgcatcgcatatcagcccatccaatggcgaccctgatctgcaggtggcttcccggtgatgctgatccgagaaaagcaatcaggtagggcttaaacgccgggcccgagtgagacatgcggtgggtgcgcagggagattgaagtgattactagtacgatatcctggggtttagtaagacggcttactaatcgagctctgggtgtggagaggttagctctctactcgtactccccggacggtactcataagatgaggataaaacacaccagcggtagtaagagaccgaagtcattcttcgaccacagtatctatattaatcagcattctgaacaactctttaattcgtcgcaactgcttagtcacagtaatctattaccccaccctccccccactcgccaatatgaagtatagccaagccgcacatgaattaaaagaagtctttaaacgcatagacgagacatgtagtggagaaaacgagctgaccaaataacaattaacaccattcaactggatcattaaaaaaaaaagtgttcacaattcgccaccacccaactaaccgtcaactcacatgtatgctgcatatgcataaacacacttaatcatctgtttagtctcacttatcaccacgtcatacggagattagaaggtattgatcaacactcaaggagactcgaaagacgccccaaaagcagtccgtacacgcctcaccacccgctgactcatcaaccctaccaaccatggtcaaacagatctttattgtgcgacacaccactcgtcaggacacggttcagagcaactgggccgaaacggctgaatatggatacaatcctccattggctgatctcggacactcgcaggccacagaggcgggtcgctacatccgttccttaatgcatcaacagcccacacgggtcatggtccacacgtcgccatttctacgatgtgtgcaaacagcagcccatattgcggaggaattgattggatgcaatcccaagattcgaatggacgcggctctaggcgaatggctgacgcccgactactttgccaactcgagccctcctccagacgacaaccatgccgacttggccaaccaggctgtgtctgcgctgcaacgacaaagtaagttacgactggtggagaacggatggaacattacctgtctcggagactcgggctccatgcgcgagttctggtcggaaatgcatctgcgattcgagcattatctcaaacgtctgaatggcttctactctaaacacaaccgcaagattgagacgctcatcatcgtcacccacggcgccggagtgtcttctctgctgacccatttctgcggcgagcccgtgctcagcgaaatccggctcggcagcatttctctcgtgtcacgcgacgaggaggctgacgaggccggctcgtttgccagtgccggcaacaattcaaaggactccgggtcccgatcacgtgcggggtccatcaccaactgggcgtggctgggccccgatcaggtggaggagaagtttagcattggctcttggcagctggacctcctgaacgttgcagccggcacgacaggtgcagctcacaacggcagtgttcctggcaggtccaatgttgatggcttggcgcccccgggcagcgacatgtccatgaagcgtcgaacctcttcgccagccatgtttatgctcaacaccactttcctcggctcggctcccccctcaacacgtacttcgcgagcctcttctcttttgcgacctagcggccctcctcagattttgtcggtgcccgaaggagtagttactggagacagcgcgtcgcaaaaggcttgggttgctgctactacagattctactagtgctgcggcttcttctgctgcggcttcttctgcgaccgcctctgctgccgtttcgtctcctgcagccgctcgcactagcggtgggtcgcagttgacgccttcggcttccgtgccggcaatgctcgacgttgaaagcggcagcagaagacaggagccgtctaccattagtggttctgcctctagagccccggagtcgtcagacgccccttctacgccgcccagcgagtctcccgaaggctcgcccaccacgtctcctcagttctcgtcgggcacgtggctgctaggctccaaccgttggtgaagggcgcctgcctgctgcagcccgagcggcaaataaaaagccgttggaatcaagcgaccgttggatacggatgcatgcaactttttcgttccttcttttattttttcctgccgccgctctgggctgcattttgcgcttttcctgccctgctgctgcagcgtccttgatgcatctgcgttcctttttctttgttccgcaaccctaattttctattgctgtgaaagtgtgccgaggttatgccgaacggaaaaataggacgaataataacatctatcgaataaaaattctcagtcggtgatagcgggaatagtgcgtgacaagagagaatgtgcagtccgcgcctgcgcctccacagaggtgtaggtgtaggcgtaggtgtaggcgtaggcgtagtatcgttgtcgtactctagaggttctgttaatgtatgtcgcttgtagtgtcaaactcgtatcaaatcgtaccaaactcgccgaccgaggctggagcttggtcgctcacaccatcgtaacatcacgtgctcctgcgtgagttcaagtgggtctcaaataataacacattttcgccatggtatgtgaaattgcacgggatggtatatccggcatcgtcaatatgcggaaagcctattattgatacttctgacagtcgatttgagcgtcagtcaggtcccagggcggagtcccagtccgagttcaggggaaggcgagaatttcttttgcccgtgctttgcccttgctttgcccttgctttgcccgtgctttgccctttcctttttggccatttcgcctgtgttattgatccgtttaatggcgcgttggacatgtgtttagcgtttaaacacgggctttttccggcttggcacgcaatctatgagatggaaataaacggccatttacacacgaacccaaagtcgagtgccactctgattgtcggctaccgtcggggtttccaaacgtcttttggcgcttttttccaggaggatgaggggaagcctgtgcagagcctcagacacttggcgggtgaaaaatttgcgatccgtggagtctcatgttactcgatgtagcgaaacggtgcgctgcgataccgtgcgcagcgaccgtgccctctgcggtccgtactgtaccctctgtacctccctcagagtgacgcggactcgtggtcgcgcatattatgcttggacgcaatgaaacagccgtagaagacggccggtggtaaacattagacgccattggatttggggaccttgccgagatgagcaagcgcggccagtccgggaatggggtggtgcctgagcagtttggggtggtgtctggcagtcaggaccgacgctcgttgacggtaggcttacgccgactgcatcggtagtttatcccgttggcacgggcttgtcttgtcttggttttggaccaaatgccggggtgtttggacaaacgaaaaaccaaaccaagggaaaccgaaaagccagtcaacggttgttgagtgagacatatttggaaggtggcacatgatgaggttagtgtgcatataaccaaaagtttgttgctggaagcgaggagtgtggaagggaggcttgttggttgtcgcaggggtggatctgatgcgaggagttggtgggtggatcatgatggggcaaggtgggtgtgtagttaaacggttgaggggggaaagcgacagacccagacggtcaggtgagacctgagacacagctccgtaggaccataaatatacatataaactccgggattcccctcaaccgccgtcactagcacccgttttgccccgtttgttccgttgtctgtccgctgggttgcacccctcgcttgccagcgtacacgtcataccaaaggcacagtgctttaaaatagcgtttaacgtcttcccttgtctggcgacgtaaaaatccgtgtgaaccaaaagaagacaacgccgcctgtttgcaacgttatctgcattttatcgtctgttcttttgaacgttggactccctcacacttttttaaaatcacaaaaacacaaaaaaaagggaaccgccagacggaaaccggccgtgtgggttgaacttgtctacttgtcgtccactgcgttttcttctttcttcctctttcttatcttcctcaaccctaccttgaccaaccgctaacgactcgacactcgcaagtggagatacactccagttacgccaaccgattgcacacgacaccacaaccaaacgagctacacagaaacaccgacacaccattccaacacacacagcatggcgatgaaatacgacggagccatctacctagaccccagcttggcgccagataatgtgctgtgccaggaccgaccgtccttcttctcgtggcaaagcaggaccgacacacacagcaacaaaagcacaagcacaagcacaatcacaaagcccaccgccagcatcacaaacaacaggtcgcgattcgtgccggtggggaccggcagtaaccagggcagcttatacgagaataacagcaacgacagcaacaatgttagcaagcccatttcgcaggagttgcacgaacagaatgtggccgtgctgcaggactttgccaatgaacttgtgctcacggactcacccaagcatgtgtttgacattatcgccagcaccaacaagcccgagcgaaagacgccgtcactactgattgccatcgacgtgacgcagtactacaccaaccacgacgactcggcaccgcatgaaaacggccactcggacgcacaccacattaatcacaaccaccatagccacaaccacaagccaccagtgtcagcccggtccatcatctcgcagatttacatatacttccatcatctgcccatctccatcgtggccatctcccgagatggagccgtgtgcgacgtgcagttgtactcttcgggagtcgactttgtgggtcccaaccccctcaagcgtgagattctggaggctactgtgcaggagaagtccgtcttcctgcagaccatgtcgcatcatgtggatcgaatcaagctacgggtgggtctgtcggataacaagagacgacaaaacctgctgcggcacctcgtcattgacggccgaaacgacctgcagttgctgcttcagttcgaccatggcttttcgtacacggaagccgacctggaggctgctcgagaacggattgctgactgggactacgatccctttgagctgtcgtacgatgagctggtcatcatggcgctcgtcatgttccagtatatcttatctcttcctggcctggaaccctaccgactggaagagcccgaattggtgcgattcctcatcatgatgcgggacgcataccaccatgaaaacccataccacaacttccgtcacgccattgacgtgatgcaggccactttccagtttctcattcgactgggatgtctgcctcctcctccatttaaacgggcccccaattgttccatgattccgcctatcggaccggccgtcttcacccccgcagagtcgctggtggttatcattgcagctattggccacgacataagccaccctggggtgactaacgccttcctggtgagctcgcattcgcccatggcccaggttttcaacgacaagtcggtactggagtcgtaccacgcctgtgtgctgaaccgggtgcttaacattttttggcccgctacccaggagcctcacctcaagaagctcattgtggagtccgttctggccaccgacatggcccagcatttcaactatgtcgaccgttggaacgagctcagcgcacggtgccgaagcaagggcaagggccggtgcaacgaggagcgcggcaatctgtcgccagcagaccggcagctggttggcagcatgatcatgaagtgcgcggacgtgagcaacgtgacgcgacgactggatctggcagagaaatggggccgggtgctgcagtgcgagttctccgaggtgaaggacgtggagacagactgcaacgtgcagacgctgccgcctaactgtggcaagaatgcgaacctggcgcagtcgcaagtgtcgtttctcaatatttttgcatatccgctgttccaacagttttctgacgcgttccccgagtttgggtacgccttcaaaacgctacaggagaacaaggcggtgtgggaaagcagacttgtatagtatgtattatagatgtgatagagtaattatagacccctaagtacttgatcctacagcgagtgtgagcacgacttttgctgaagaagagagggacttttgtagggagagaagccactttgtacagtgcacagtacaactacatttctgggcttggggatcataaatgacacttatagaccatgcggataatgatgtattttccgtgctatagaacattggctatgataactgttggtctaggtgtcgcacaagtctgtacatactgtgtacatctacacataccgtacttctatacaagtagtgacttcgggcatggagttatgatagttgtaaagaatgagggtatcagtacagtgtgcaagcaccagtataactaacgattacatcatctttcagagcatttgtgttagataagcaatgcctggaaatgttcgggtcacgtgccagacgcagcgctatgttacacgttactaagccaggggtgtgcggtagtttggtcggtattatttgccggaaaaacaagcgaagataaaaccaaaaaccagacattattcggtgcagtttattatcgcttctttattatatactatgcagtgttaattatattggcaggtggtctgggatgtacatactgtacagtatgtgatatcggggtctgcccagcttaggaaggtctactcggtatatattatggaggtagccgttggttgataccggtatcggtgccggtacgagtagagagaggaggaggggaagtgaaagacttacggtgagagagtaagaatcgtttggatgttgaggtggatgttgaggtggatgttgaggtggatgttgagatggaagttaggtggaagttaggtggaggttaggtggaggttgagatgcaggttgagatggaggttgtaagaagaagtcagacaggtccaccccactgagggagagcagtgatatctttcctctctattatcaatgattgaatagtagtaaaagtacgattaaaagtctgaaacgttccgccggtacttgtgctgtagttaccagctcttggcagctcttcgcaccagttgttccatgtacaagtacacccgctctccaagcctgatggaatgatcacccgcaacaactctcggttctgtaaattacagactgaaaagtggggagaaaatcaagcttggtttattgtgtcttagatacgagctatacggacggcgatcagttgttgagagacatacattgcttcacgtagtggtgatagtagtgataatgtcgagaattgtcagtcacagtcagtcggatgtactgtagtcggccattcggacgtactgtcgtcggaacaaccaccgtactaaaacacctaggttctaactccgatgttgatctctattataaatgacattactagaaatggctacttttgcatgcgccgccagtggagtgtgttggacccgtacaatatactgaacaaggctgtcttgtactcgtactcgtacaacctccatgtacatactgtacctccaagaacagtgtcaaatgcgtaggactcttctcgtcttgctgtggttgcactcgaccgcagagttcgtgctccgagtcacacgctgttatcgccgtgagttcgggtgccgagcacttcaaaagtccacttctcaaacaccgcccaaggtaccatccttctgtgcatccctgacctgctcaaataccttgagcatctttcttctcgcacccagggcgttgacacccttttcctccagctgtgcatcatccaactgtacaatatcttgccactccatatccttgaaacactctgtgtacttgtgtaatctcagggctctcaaccatgcactcacgtctcgtagcagtttgatgtccgtggctggagaggctgaggatgccccagacagctgtgtaatggaggaagaggacgaggtttgatgatggcccttcattggagttgccagggagtgggctccgggggcgggagagccgcccggagtacctggctttgtgggggtcgattcctgcgagtttgtgtgttggtggaacgagcttcgtttgcttctatcgtctagcgaggctcggttggacacggtactcagagcagccagcttcatggcggtggtgtttgcaatctgggcgttgagatcgtgttcgggggtagcgatcatggatcttcgcgacccgatgggctcggtagacagcgacgacgtgtgtttatgggatggggtagaggggaaggtaccgacaggagcatagatggggttgtgggcgttggggttgaggttggagtgggtagtttggtgggggtgcagacctccgaggcctccgagaccgccggtcatggcctggcccatagctccctggcccatgggggagggctgggccgaggtctgttgctgttgctgaggggctccgttctcgaacgagttgccaatgggagagccgtcaaagtccatgttgccaaacttttggagcacggtgatgaagaagcgaatctgcacggggttggtctgttggagcaatgcgtatagggcggcggtccgttctccgtccgacagaacgccaaaccactgctcaatggagctcagctcgtccttgaagtccttgtccagcgacacagtggccatttcctccagaatcgcattgtacagctccaggtcctgcagccacttttcgctgtccatggttgctgtgttggcgagaccgcctcccaggtgctggagccccggggtggttccaccgaggttcagattgcccattccggcgctcagagagcccagtcccgccgtggcggagccgcccagaccatacggcgggtaccctccgaggtccgagtgtctgtaggacgaagaaaaggcctccgaaacgggccgcgttcgtcggcccgccagaggcgattcgctctgggggatatcttcggacgtgtggagcacgtggcccggcatgaatctggggatgttcatcttttgtgtctgtctgcggggtctgtagtgtgtgtcgtgtcgtgggctgagcgaagcctttgagttgttttagaaacgtaatcccaactgttaacgataatagttagtcctatagtcgacccaacctctgctgcgatgcatctgcttccagtctgaaacacgcgtcaactttgtttggaggggagggcgaggaagacagtctggaggggctgtgcagctatatatatatatatatatatatctaagatgtatttgtgacgaggggcgccactgaagacgaaaatgtcacactcggagtcaccccttccattacccagctatcgcattgtagtagcagctaatgatctattgccacttttagactgggccgttttattgtttagactattttgggagccacaagcgataatataccaaagcatgcccaacatcatacaaccagtctacaacgggcggtagggccaattaaagacacggtaggcggagaggtggtcgatgtgttacgtaacaaacgattctacaatgtgtgctttgcccattgtcccttgcacactgtttgagtgcggcttttgatcagcctcgtgtgatgcctgagtgagtacagcaggagtgagtacagcaggagtgagtacagcaggagtgagtacagcaggagtgagtacagcatgagtgagtacagtagaagtacaagagtatgtactcgtactgtgctgtagatattgtatgtatcgtacatactgggcgagatagaagataaaacaacaagacgtatagtacgtgctcgttgtgtcctacttacagtatcgacattgtgctgtaattggtctcagcgttcgagtacgattctcactcatactcgctcacaggacctctcagttctcctctccacacagccctttggctcgcttcacagcccacctggaatggcctgtctcggcttgtctcagaatcgaaactcatcgcacaagagaaacttcccggactagacctctgcagacgttgatcgacacgtgattcgtacgtcattccgccgacgtgtgagacctgaattgcaagtgcaagcgtcaattggtcccgtgacggatatgtgacgttgcactgtcagatggcaacgtgtgggaagggtacagtacgagtacgagtgagagtatgagtgggagtatgtactgtacccgtgcgagtactccgtgcgagtactacagtacgatacagtgcgaatacaaataccgtgcaagtacttcgtactcgtactcgtacccgtactcgtactcttccagcactcctagaatcaaaatcttacagtacccactgcaccgtacagttcatgctcgactcgtgatagatccagtggacatttataccgttattggcccaaaaacctcaattaacgacaggagacacggattagcccccggatcagacggcagatcgatccgaatcaatcaaccgccgttttccaatatctcatcactcacatctccgatactcactcgattgctgtcgcgtttcgtcgcactgctgcataatccagggttggggtagttccaaaaccggcgcaatgccgcaatcgcgttgcaaaggggcaataatggtgggtgcttttgttcggttcggtggtggcggtgtattgtgtctgttccagtactggtggtcgttctgcagtcgcaggcctcgagatcgcgtgatctgtactcttttttggtcacatgaccgtaactctgcatggtcgataacctcacaatggggcttacaggattacattacgcctgacatgtcgagcggatgggtggggtgacaataggccaaagtggagagaataaagagccggaggagcagattttgacggagaaaagttgctacggaacaggaggagacaggaaaataaagtgggcgttgccctcgtcttatatggtgccccgactacgtattcggctcggtgccaagtcatggaaccccatggaagcaaacaccggatatgttttcacccagagaccgtgccgtgagtcactgttctgccaaagttacagtggaccgcagaagcagcacaggagcagcaccaccaacatattaagaaagcttccacacgcgcacaagcgggttctgggcagtgggacatttggggcgtggcggcaggcatggtgacaacgctcggtagcattgagccaagagggtcgtacacagtgcaaaccccattcgctaggggcggagcaataaggtgggaggtggctgccatatatatatatatatatatatttattttatatttagtggggctagattgagagcaatattgggtgacacttggggccaaaaaaacgagtatataactcggtggcgtcccccaacgagacctgaatcacagtctcaagaataaccgttggcaccaggcaacttgttactgttgctgtttaccgaaccgcctcgtgggcaaatctctcaccacaccttctcccctccccaacttaccctcccgtgacaaggtttaggaaaagacacacgtattatcatacagtcagattttatcaacactctcccaccacacggccaccaacacgccctaacatcacgactactactactatggccgatcagaaagaagttgatctcgactccgtcatcgacagactgctcgaggtccgaggctcgcgtcccggcaagcaggtccagctgatggagcacgagattcgatatctttgcacaaaggcccgagagattttcatccagcagcccattctgctcgagctcgaggcacccatcaaggtgagtaattggtttttttgtccagcggacagagggggtttttggccggctttttttgctcgcttttttatcggcgttttgtggccctacggctcgccggggcttttgttgggcctttactcttatcgagggggaaggtccagataaccgcaacattgccagagccacttttggtttgtcaggcaaccaatcaatcgccacaacacacaacaacagcaacgacatcgatcggaaaaatcacagactcgggaaaaatacagactttgatttcaacacacgtcgacaacgatccaccatgttttgccacaacgccgcatacgcatgctttttttttcccgttgcgggcacctgtatatgcacaacacaccacacccaccacgccatgcaccatgccacgccatcgacctgagaacggagaacgaagatgaaaataataccgacgaaaaatggcatttaaaagtggctatcgaaaagtgggatatcagatgccgttgatggatgctcctcgcatgtgaacgttctgtgtgtaaacaacgcgccttccatgcctgtcggtgtgtcggatttatttgtgctgttgttgccgtgttgtttctactggttgcttttgccttcaattaccccgttagccgtgttttacggccgctctcatgagctccttactaacccagatttgtggagatatccacggccaatactacgacctgctgcgattattcgaatacggtggattcccaccggaggctaactacttattcctcggagactacgtggaccgaggcaagcagtcattggagaccatttgtctgcttctggcatacaagatcaagtaccccgaaaacttctttattctgcgtggaaaccacgagtgtgcatctatcaaccgaatctacggcttctacgacgagtgcaagcggcgatataacatcaagctgtggaagacatttaccgactgcttcaactgcctgccgatagcagcaatcatcgacgagaagattttcgccatgcatggaggtctttctcccgagctcaacaccatggagcagattcgtcgtgtgatgcgacccacagacatccccgacgtgggtcttctgtgcgacctgctgtggtccgaccccgacaaggacattactggctggaacgaaaacgaccgaggtgtgtcattcacctttggtcccgacgttgttctgcggttcctgcaaaaacacgacatggatctcatttgccgagcacaccaggtcgttgaggacggttacgagttcttctccaagcgacatcttgtcactctcttctcggcgcccaactactgcggtgagtttgacaatgccggagccatgatgtctgtcgacgagtctcttctgtgttctttccagattctcaagccagccgagaagaagcagaagtttgtctactctggcatgggtggtggccggcctgtgactccccctagaaagcagaagaaggcaggcaaataattgggcatagatggaaagtattgttatgtataaacggtgaggataaatgataatgaatgaaagagcacgcggattgaggtagtggcgcgaaacgatgtactgtatgtattgtagagtgacgttgttagtagcactgtgttggtacttaccgcctgtgtaatataatacactgcatctatgcagaaactctattgaaccaggccccatcatctcggccacaccggtgtgagagtacccttcaacaacatgtaccagcctccgcgaccttttgaactgccatcggacctcgcagccggcatcacgtcgctgtaccgcgaaaatgccgacgccaaagtcatcatagacagtctcgtgaagctcgcttacgacagtggtaaggagcagtcggagctggttcacaagaaggccaaggtggatgggccgccagctacgttgtccgagagcatagtcagcaagctgaagatctttctgggcatcaatcaggtgagcgtggttttaccgatccgcaagaagctcaacgtcttcattggcgccgaccctcgaggcaagacgtgggtgtgggtgtcgtccaaggaagacgggtcagtggacgacatgtatcctgcaacggatacggccgactttcggtgtgtggcttgtcttcctgttcccgatcgatcgggaacgcctctgttcaacattgtgtttgttccaggcggagctgcccaggaagtgaccactcctccacagccgctggtgttttctgtgcctgaggagcctgctaagaaggcatttgacggctcgctgtttctgcagggtaaggacaagaaccagttcatgtacaaggacctcatcttgctgggatgtcagggcatctctttgcccatttcggtccccgacacggagattttcggcgaaaagttccacgtgcttgctcataagggcgcgcgggagggctatttgtttttcatgcagaacgaggtgattttcggcttcaagaagcctctcttgtgcatgaacacggaggacattgagtccatttccttttcaaccatcaccagactcaccttcaacatcaatattgtgctcaagagcgctcccgatgtggctatggagttttcgctgattgaccagagccactacggcgagattgctggcttcatggagcgtattgctgtgaagaacgaatcctttgacgataaactcaaggccaagacatttatgaagaaccagcagcccgacaacatcctggctgttgcccagaatgaggcagagaacgaggtgcctgtggcttacgacgatgaggacgaggaggacgacgaaaactacactggagagtcgagtgcgagcgacggagatgccgatgagagcgacgaggaagaggccgaagagatggaagagcaggagagagagtatgacgaggagcttggagacgacgaggtggagcatgatgaggatttgggctagactgcgagttcatctatgccattggttgtataattacaagaatatgacggtatacactggggatggtgtcgacgagagccgagtgtggcgaagggcaaccacttgtcgcttctctccgcagatctgtctgcaatgtagttacacagcagtcttctaaggaagatgtatggatgggactaagctgctcgaggtgccagggacgttgtcgcaggtggcgaagggtcagagtcacaatgacacgggtgtgggtgtcacggtggcgacaactccagtgacaacagaaggatatgaactgctacttgggtacttctataggttcacgggatgaaacaagacgcgtatggatccgagtccatagcaagcgtggaccgaggaggttcaaccgggggtttacaagggctgaattgaagcatgcaccgtcaatcggatgtttcaacgcgatttcaggcacattacagtcaaataactgtcacatttggtcgataacatatgattcgctgtcatctttggtctgtgacaggctcatcaaagtcacgtttgactccaatatgtacttgcagtgcatgccgttatggtacatatctgtttggttgtaatcgagtatcgaccaggagttgtactgatgagtatactgaaattatctggacttggtaggagaaatacttgtcgagttccatttatttgtactcgctgggaccgttcgtgaggtccaacagtcggaaactggtggtcccagggctgtaagagacatgaagccagtagttatcgcctttgaggggattcacctactcgtacttgtattgtttggtgttcgagtagctgtaggaatacattccaggtgagatttagttgagatttagttgagatttagttgagatttagttgagatgtagttgagatttggttgaagactgagattcatattgaatgctgcagacccattgggaacataaatggtccggaaaagactacccaatgaacaatcgttccccaaatacgagataaatggatgtttgtgagcaatgggacagtctgcctgaggttggagatgtgtgatgttggagatgtgaggttggagatgtgaggttggagaagaatgcgggagaagaatgcgggagaagtatgatttgattagttatattctgaccaaggcttcagttcaagggtcagaccaagttgatacggtggacgttttggaaacaggataggggattacttaacatagcaataaaggaaatgccttggaacttacataatggtacgacgctacttgtaatttaacagatagttgatgttgcacttgttgatattggcgttggagacagtagatacccggtgagaatcttgggagtctccgctgtaacacgtctggggaggaggctggtcgtgaaggggttctggagcggcgacacgtgacttggtgaaggcgtcacgtgtttggttgattctgctgtgtttcttccccaccctgtatttcatgtcaggtagcttgacgtaaacgggtgttggtacttgtttctggttggcatctccttgacgccgagtgttggtgtcgataggggccaagggccttctacttgtagtgcgtttgggtcggttctggggtggtatcatctgctgatcaggtccggacttggactcttccaggtttctcaagtcttcaatccatttccacattttgactcgttggtccatgatggaagtttgagagaggggtcttggtcgtgatatagaaagccactgttggttgcaagagtcggagttgagacactcaactgtcggccccctgtcggccccctgtctactctttatatatttggccaatcgtagtgaggcaggcatctagggctcaccctgcctcagcccttggagcgtatgaagatgcttcaagccccaaccagtctcagccaagcctcatcaagaatcaactagcaagccccaccaagacttgacaataattagccaagacctaacaagaattagccaagaattaacaagaattgccaagacttaactagtaattgccaagactcaacaagcatcaaccaagacttatcagtcagtttttgtccctcgaagcaaacaatctcatccatcgtagcaactcagtcagacccctgatcttgcaaattccgtcttgtctggtccactactgtacagtaccagtacaaggactcatcgtactccatgggactatccttttgcacggtagctactctacaatactcactcagcacttgaggctcacaagcccggtatgttgctgtatcatacgtcccactcgaggcgttagatcaggagattggcgtgtttggaagcaaaaaacaacgccagttttccatcatttttatcgtttccatcattttcttcgttttccatcacccgcaagtgctatgctcgtactgtacatacatactgtatacaccccattttcactgcaaaagactgccaaaatacaagagaatttctatcaataagtccttagccaaaaaagggctacttagaaccgaaaggaccatcaagccagctcagtatatttctcattgaaggaatctatagcaaaacagtaagtacaaaacacgagtgagacctagcgatgctcatgtacttgtaggttcttcatgggatgatctccaacaaatctcgccttactcagttctactcgaaccaaactatacctggtgtcgttctcagaggaatagtgcgatttgtaagtaagcaccggtttaccatcaattctcgatggatttgtcagcatcgtcctcgtcggtttatatcaaaaattctcgatggatttgtcagcaattgcactggtttaccaccagcaattctcgatggatttgtcagcatcgtcctcgtcggttacatcaacaattctcgatggatttttcagaattgcactggtttaccaccagcaattctcgatggattttgtcaacatcgtcctcgtcggtttaccatcaacaattctcaatggatttgtttgatttgtcagcaacaacgaccgtttatgctttcatactaacccttcgaaacctcgcctcaccacgccagtgcttcgttgctgcagttaccctacccgtttttcatgtagccgcatctgataaaaatttcacgtttgagtttcgattcccgactgcataattttttggcacccaaatcgttccacctcacaccaccacacatcaccccaaaatggctaccgaaactctccccgagctgaaaaaagtgctgctgaacgaagacggacagaccgcgctggccctgcggttccgagcgctgttttcgctcaaggacatgggtgaaaagggcgacaacggcgccatcgatgtgattgccgagggcttcaaggacgactccgagctgctcaagcacgagctggcctacgttctgggccagaccaaaaacttccacgcagtcaagcctctgcagggagtgctggccgacaccaaccagcaggccatggtgcgacacgaggctgccgaggctctgggagctctgggagacaagggctccgtggccatgctgcaggagtactttgagaacgaccctctggaggtgattcgagagacgtgcgagcttgcactggagcgaatcaagtgggagaactcggaggctgccaagacggagactctgcaaaagtctgcctacacctccattgaccctgctcctcctctgcccaccgaccaggccgagggctccgataaggccaccgtggagaagctgcagaagaccctgatggacaagtcgcagagcctgttccaccggtacagagccatgttccgtctgcgagacattggaaccgaagacgctgttctggcacttgctaccggcttcgatgactcctctgctcttttccgacatgagattgcctacgtgtttggccagatgagcgatcctgcctccgttcctgctctcatcaaggtacttggcaagaccgaggaggagggaatggtccgacacgaggccgctgaggctctgggctccattgccaccgacgacgtgctgcccattctcaagaagtttgccgaggacaaggaccaggtggtccgagagtctgccattgtcgctctggacatgtacgagtacgaaaactccaacgaggtcgagtacgctcactaggagaggggatgatatttatacagagtaatagacttgactgaacaagagaagttgaatgaactggagagattggtcgagaacttgaaagaagtcacgtgatcataagggaggtgttcagaagaaatttgatacttggtgtgggtacggcgagagcacacggtatttgacagtctacgaacgacaatgtggctgcacaagagtgggaaccgtcagtagaggaatgaagagtcatttttcaaggcacgaaagcatctaaccgacacataaactggagaccaaagttgtcaactcctcttatccttattaacctgcctttccgcaagatgagcgagatgttctgtagatggctccgtcatacataccgcgagtaggatgtactctatgtactatatgtacaatatatcgaacccgattacttcaaacactggatctacgagcatcatcaagatagatttcgtagacttgatcgttcaagacacatcccacagtcctgctttgatgttcggacttgaacatactctacgcgcgatattcaaagtctgatatatttgcaaaccaggaatgtgtttgctcatgctatttttggagacggtagacatgccacatgccaccagactcatagtatacaataaataacccctcctctaattattggttcggaacttgtagtgacacttggtacaggtgtagaagacggtggcaccttcatcggcagatcgcagctgcagagtatggtactgcatctcgtcgtggccacactgaggacacttttccttgatgatggctccctcgtcggcttctccagcggccagagaggtcttgacgacggatcgtttggaccgcagggccgaggggaatgcgtcgggggcggacttggtcacgactgtgaggttggtggtgtctgtgttagaaggaatggtgaaacctaggctgcgacccgtggttcgagattgtatgaagtactgaatggtagagggcgatcagagacacttgcaggggacgatcatcgatcggactcagaagtcagacttgaatcagagatcaatgagcagacttgaatcaaagatcatacacataatcaacgatcagacatataacatcagatagagggatctaaacatggtacgagccttccatgactcaaaatgatcatcccataagacagacaggaacatgtatatctcaatcatctgtctatagacggcattagaagcgggcggacagacggtatcggatctcccctcatctgctagacatatcgcgttgcccaccatccattaccagcagccatccaaaggagtaataaagacaagttcactcgtcacccaaaccgcgtccttgtacagctcctgcctctatctccgtccctctgcttccatctacatcaggtatcttcgatctggtatcgtgatcattctgtacatctgttccgatccattaagtcattcgcataactcgtcgccacataactcgtcgccacataactcgtcgccacatctccacccacctcgtactcactagctgaagggaaagaagcatcacattgatcacactcgagatctttgctggcgttgagctgagtgtccatgagattgccgcaatccgtgcaaaaaatcagagatccgactgccgacatttttgtagagttgcgttgattccagtctggtagacggccgtgtttcaaagagccttctgcttatcgccaaaaatatgcatggtgtaggaaaaaaaatttctacatgcagagtcatgtgatatcaactttatcagtggaggatggagggcgaaacagcaccgagggtgtaaaaagtgcggcagagggtacggggatcgaggaaatgggtgtgacgtgatgaaacagcaagttttttttctttcttttttttcctcttttttttttctcttttttttttctctttttttttttctcttttttttcttcttttgtttttcttcggtcagtttacgagtacatacatattaaactgcaagtggagtagtcatgaggcacatattattttttatttttatttttatttttatttttatttttatttttatttttatttttatttttatttttatttttattttattattatatatatatttatatattttatattttttaatctaattttatgtcaaagtgaaaaattgtgaaagcaaatcaacaccggctgacctccaaaccgattggaggcatggaatgtgtctcttgttgcagccattccgagttgcaaaaccacgcggatgtggttgcacggttgtggttgcgcaattgtcagctttttcaagtagcaacgaagtgcggcgtgcggtattcgggatagtggtattactgtaactaatagctatccgtactcgtccaagtatgtatgtactataccaacgttacgacatatcatgaactacctgtgcaagtaattcaccagctaaggcttactcagcagttgttatagtagtatgatacgaaccggtatatacgatactgtactgtatcgaactcatggaatcggatatcaatcttgtgaattgacacattctcgattgggtacaccgtacggtaagtaaatacttaaggttttacttaatagagggtagtgaggtgatatgttattaattaaaaaaagaggaaagggcaactacgagtacactgtgtaagtaccataaaagtactcagtagaaccatgataaaaggagcataaaaccacgaatgattactcaaactcgaatttgaactcgtactcgcactcgcactcgctctcgtaagctcctcacgatgctctttcgcacttgtctttgcttgtaccccttctgataacaacatcccatttctcgtacccagcataataacagcacattttaagcagagggattcagggggcggaaaaagtatatagaaaaaaacagaaaaatcttgtctcaaaaatgggacataatattacaagtacgagacagtgtccgaaacacgatgaaaccagaatgtatcacaacgtgcgtaacgcactgaacccgtatatggacgttctctcgcatccgccgcaagtcagggtcacgtgacgcccagaacccgtaccgtatacatttatgatcgactggttgcgccatgctgctggatgcagccgcaggcaggtgttgtatggtatacttttgtaaagggagccgccggcctggggagtgggcgatacagcgaagcagcagaggaaggtgtttggatgtcacgtggggtgggtggggcagacccacggatggtggtgttaatgggcgtcttttgaccatctttggcgcgaatatgttgggttgatacgcgctaatgtgtcgtttactgcgatattctgtaccagagtgggttctgtagctacgttttagtttggaggttaacagggtctgttttttgcttttcttccatgtctgggggtggagagtacacagagttggaaggtacgtacttacattcttgtacttgcacttgtacttgtacgtgtacgtgtacttgtccgtttaccgtgggttggtcagatccgcagtgttgttagatggcgggttgttagatggcgggttgtccgtcccggctgaacagaccaaacatcaggccagtatgaggttctcacaccgcacgtacagtcagactcgagacattcgtcacagacgcacagacgcacagacgttagttcagatggtttctttttctgcgccgacgacagcttgcgtagtggttgcgtagtgttgttgcgtgcgttgcgtgcgttgcgttgttgcgttgttgcgttgttgcgttgttgcgtgcttgttcttgtgcttgtaaacagagcaaagagcattgtacgatacgatagttcgtacgatactgcaagcacttttgtgatgcaaataatgcacaataaagcacaaaaacgaggatccggctgaatttgaccgcgagaaacagacctatctcactgtccactcacaccaacttgtttctcctctgttttctttttcttttttttcttctctctttacccttctttttcccccttttctcttcttttgcccttccttatatctcttctttttctcttctttttctcttctttttctcttctttttctcttctttatctcttctttatctcttcattttctcttctttatctcctcttttcccgtctttttctcttattctttttctttttctttctcttattctttctcttattctttctcctctttgcctttcccttttcttttaccttatcatctacaagtaacttgttaagtttgatcgctgcgggaaggcactgaaacggtgtgaatatccgaaccaaaaagctaaagccctgtcaggggtgatgcatggaaccagagggcccacgccggaggtgatttggtgacgcggcgacgaggtcgggaatccggtgacgcggcaacgagcccgtgggtctggaccgtcccagaatccccatttgctccggtcccagaaaacctcaatggctacctccaccgaccactcatccgcctagcgaaaacaaggctgaaacagagtccgaaactggttcgtctcggacctcgctcccgtggataaggtgcgtttgtcatgtagcgggtcccccgaccgagacatgagtctgatcccgcccgccgtgaccaacttgccctcccccccatgaagcgttttttccaccgccaccaggcgtcccagagcccgcccatgcctctgtgcgactcccacaggtttgacagccacgaccagtcggcgtggatctcgctgggcaacggcgagaaccccgacccggtccctcagctgcccgaggtgcccgagctagcgcccatccgcttctccagaatgaacttcgaggtgtactcgggatggaagcccgacaaacaggtgattgacgagcgggccgacccgcacgagaccgactcacacgagaccgactacaccgctgaccgagaccaccatagacacaagtcgctgcgatcgctacagtccctggacagcctggggtcgtcaagcgattcgctgtcgctgccgtcgttgccatcattcgcctccaccatctccgactcgtcgttactgggcatctgtgatctcgactctcacagtctcgacagtccccagagccaccaaacccatgtttcgaatgataccctggtccaaacccccagcaacagtcacaactacacaaaccactccaccagcagcttgagccatctcggagactcgcaaaagagccccgccgctcttccaagcgcccactccctgcggaaaaccaaatcaacgtcgttcgaccactcctccctccagccctgggaactgtcggaggatgagtacaacgcctacaaaatgaacgcgctgaagcagatcaaaaaccgccggcgtcaggagggcaagctgccaaccaccaaaaaacacaaacatagaccgccccgaatccttgttccccagtcaccccccaagctgcagctcatttcgcccctgaccccgactttggcctcagctcctccatcccagcccccgcccaagctccctctgccctctcttgcagcttacacccgcatgcaaagcagccagacggggggatgtgcagtacgagtagatgcaccaaacaccacccatcgcaacgcttcctcttgcacagaccttactgatcaggctgacaacaccttcgacacctctgtcgactttcaggacacaagcacgttcttcacaacctcgtcttcacccgcctccgcatctcctcccacatcacctctctccgcatccacagcgtccatgaggggtctacaaaagacgaccacgggcgaaaaggcgtcgtcggaggacaaaaaagaccggcgattaatcagcagacccatgaaggcgttccgcgccgcctgggacggaaaacccgatacggaggtgggttctacggattcggcaggtccagacaacaaccctcggctaaaagaggtggattcgcctattatgccgcgcagggaagctgaccctagccctgataaaaccccaccaccagaccctagccctgttgcccctggcaaccccgacatggcggctaccaactgtgacattttcgacacctcccctaacccaccccctagccaaaccctattaccccaaaccgcagtagcttcagaacagcctcgtgtaggtggtaataataggagtgaagccgagctcgacgcgaccccgacttctgacgctcaccactcgacttgtgacgaccctatttccaacgaaccgttccgcgatatcctagaggacacgcattcctccgatttctccgacgacaacgactgtgacaacagcagcgacatccaagacactgacgcaaccggtcaagacatgaacgggcatcctcgacgcgtgtcttctctctctagcacgacttcgatgaggtctctggacaagtcgcgtgacaagccgaccaaagattcgcgcgagttgcaccagttgtcttctattaccaagggactagtcaagaattcgccctttttcgatctagatgaggtgagtattagtgggcttatgagaatgggtattgtgctataggtacttgtaccggttgattacaagtactcttagaagtactcgcgctcgcactgtacgtcgtgcgatgataggggctggaagaggggaatggttaggtggcattttcttttgacgtcttttcacgtttgacgatcttgagccacctttttctcgcctcctctattgctcctattattattttgccgttttgcggtgttactattttgccggttgccgttttacactatcgcaatttgcttttattttatcgcataattgtggaggggaaaattcaggggtaaactgccggattgcaggggacaacaatagtacagtgctaactcagaaccgagcgaaaagcggtcctcgtgctagcgtgccaaccaaggggctcaaggcaaaagttggcgaccaacatagcggcagcaacagaaatagcagaggtgacggcgacaccgattccaacagcaccaccagtgatacgaccaacgtggaacgcgacattagcagcgccggcacaaacaaggacacaaacaacaccggcaagtctggtaactcaaccaacgacacaaacaacaagattgaccccaccaactcctcctccacctccacttccacttccacaatcaagctcgtccaacccatgcacgacccctcgctgcaacaacgaggcagcagtttgagagccggtgccgggaggtcgcatccggactcgtcgacggactcggtggactcgttcaagagtactaaggagattccacgcgagtttgcgcccgacagcccgccgtccacgtcgcagatttcgacgcccaaaaaggagtcgaccaaccatctcagcagcagcgtctttggcagcgcaacgagagagccgaaggacgacccggatcaggaggacttttcgtttgtcgaccacagcgactcggtaaagcggtcgggacacaagccgtgggacaaggacgacccgcgggtgcgacggagtattctcgccgagtttgaaagcgatctcaatgacctgttgttgttgagcaaaaaatctcctgacggcgaagacatgcacgatttggagttcgatccagaggcagaaccggatgcgaatgcagaggcagctgaggacagagacactcacaccgcaacacgcgacacaccctcccatgacacaatcattcccgtggcgcctcctggtactgcctcttctgcatctacgtcgaccactactgcctcaacttcgacttcacctacacccatcacaattcccaccactgctgatgtctcagaacacgccttgggatccgtaaccacgggtatccaccccacatcggtctcacctaatacagcaactacgtcgccaacgtcaccaacgtacatggatgctcctcctcccccaccggcagatcccatgcccaccacccctggagaggctcttgacgcggagacattgtcacgtggtaagaaggcgccctccatcgcgtcaaccagcacgacaaacacaagcgcaagcacgccactctcgctcaacgccaacaagcggggtctgcgatcggtatcatcgtcagcgtctctcaagctgcggacgtctatcttcccgttcaaaggccctgcctctgcaggtgtagccacgacgcccgaaacggcctccatgaccggcagcatgtactcttccaacaccagtatgtactcgtcgggcagcactcttgtgcgcgacagtccggcggtgatcatggccaagacccgcatgcgaacgtctctcaagtcgttccccatcttgtactacgccgtgacgctctctggacccgtcaacgtcaaatacaacattgagggcgccactccctcgggccagtatggcatcttgtcgctccccacagccccccatccatgggaaaagccaccggaggacctggctctccgaggagtgtggttcctgcgtcttgtggtggactcaggcaccaacacagccggtggctttctcaccgacaaactgtttgtgccacgggacgtgtggtcgctgtcgacgtcaatgtccgccaaggtcctcgacaagcgactctacatcaccgacgagtactgccgggccatttgcgagttcatggcgtttgccgactcatctagaacgggcgtcaagggccagagttcgtcggcgcagtcgatcgacgatgccctggagcgactggatgctcgaattgacaacctctcgcgacaccaatatgtgctgaaggccgacggtgatctaattattgatttgggggccaactcgcctgattccgacgacactctaacccctctagcgtcgtcagttccttctgagtcggccctgcaccccgtaatgtcgcatcccaccccatccacgaccccaatgacgtctaacaaccgtcggtcgtcggatatcgggctgcttgccaaccacattttttccaagaaggaggagaagcccaaggaggacaaggacaactcgtcgtccaagctgttcaagcggttccagcgcaagatcagcctggccaataaccacagcaacgagaacctgtcgatttcgacggataaaagctccaacggaagagccgaggcccctccgcgcactcctatcgatcctcatcatgattatggtgctcggtacttcaacgccatttcggccttgtattcggatatggaggcgttggctcactatcgatttttgctgcagaatgaagctcgagactcgcaggctgccaagggatactctcaggctgttattgttgaggccattgactcgtgttttgctttttcgaacaccatctgtcgcattattctgcaggacgttttggccatgttggaggtgtatttggaagggggcaaggcggtcttgtctgattagccatgaatggaggacagcaggttgcgtgactaacacgagagcgccgttggaggcgtatagaggacattatttataagtaataagggcagtcaatgtgtgcattggctggttgtatttttatgagagactaacgagcattacttggtattttagaggttagtttgatagtattgttgacgatttgtgttaaaaaagcaaaacttcaagtactgtacagagcttgaacaatattgctacaaactgcatcgcaaagagaggtgttaggcattttggcggaaacaatgattataaacatttaattgagatatattttggaagaagaaacgattagtaacgtttactttattggaagctgttaatagacaatcattacgtccttctctgggattccatctcggttagttttggagatgcacatgagacgtaacctcctgaatggaggcacaagtacaagtgtttgagatcaaagattcgacgatcatcggtttagaaatagatttacgcttgtttctggatggtggacaagtacaaccacgttctttgtcgctcaattgacgagatgaagtactgaggtttttctggaaaatccgtactgtactgtatctacggtgtagttggagtatggacctggacttgtagattctacaccggttgctgttgagagagagaatatgagatcacaatccaacaaagaaacatgtgatgactgcgccactgccttttgcggcgtataaaccgttctttccgacaatgtaacgtggtttaatcttctccatagatcgacgttgagtgccaaaagtgacgatcatgggagtcttggtgtatggttttggtgttatgggcgagaataggtggtttccagtgaaacggcgggaggaggggtgcatatgagacgagataagtccattttggtgctgagaaaatcgtttttttgtgtttgtatagcgacatttgctgctcttgaagcccccactttgcccaccctgttctggagtcaattctgaacggtgtctaaaaataagactgacgtcacacccttttttttcactatttttcagcttatttctgaactcaaaactccccggaactgggtgcgtttgtagagggaaagggcggatccagggctccggggccggctaaaagggggaaaaacggactatttttgcgagaatatcggttcacagcaactattgccagtttttctcctaacattcacgctgctgtgggtgctgcggggtgtgcctgaaatcatccctccatacatggcaaatgcaggcccgatgctaccctcagagttcgagatgtatcttcagagtttggccagtgttctattttgagcacacaagtcgtggatggaggaccgttgaatgacgtagattgtgccaaacaacaatatataaagctctgtgatgtcccacaatcaagctttacacaacacccacctctacaacacacacacacacacacacactcacaatgcagttcaagactctctccatcctcaccgctgccaccgccgctctttccgctcccattgaggcccgagacgcccagcagtactctcttcaggcctccattggccccggtgctactggcctcaagcctctccagctccacggcaacaacattgtctacggtctgacccagggctactccgacttccgagccgaggacgatggcgatatcatcaagctgtttgccgcgggctaccccggactctctctcgacgttgcccaggacggtgagctcaccttcaagtccccccccgagcccaaggaaggcttcaccttcaagggtgacggcaacgtccaggaccttgagttcaacggctcccaggagttttactcttgtgccgacaagatcctcggtcctctccatccccaggttgtctatgtcaagactggcgacaagtacgagtgcgagaaccccgtcaagttcaccattgctgccaccaagcagtagcctggttatttattaatgatattgtttgaattgtaagatgatgtacaaccagttgtaaggggactgagcagaaagaggataatgtggaaacgagtcgccaaggggactttcttccaccgcctgcttaacgtaagtaagacgtgaaagaagttaccattttgcgattaggaccctttcatgtcgtgtaattgttttatttaatcgatagggtggtcttttgattgttaccagcacttttcacaaacgcagaagagaagttcaaacggttccatactgttcgtttttgttccaaaaagggggtcaaaacattatagatttagttgagaacatacttgacaaataatgttccagaactacaaaaagggaaacaatggtcctaataagaacacgaataaaactgctaggtgagagaagacactatgaacacgaaccaaactttttggtgagaaatatcaccatagatgatccagttctcatttttttgagcgttctcgctgagattaatgggtggctaaagttcaaactaaacgtcaagtaatcatagttaaaacttacagtgaaaaatgagtgcaagaaaccaatgagatatcacattgcggacttgctgacaataactaaacataaccacagtattcccagactcgggttttctcctgacacgtggtcaacgttctcatttttccgcctcacgtgacttttacaaccatagatagtcccagcagatttttaggcccgtgattgcggccatttcctggtgaaaatacggcttcccgtccgatcagccatagtcaagcaccagagagcccagttagtattgtagtgggagaccatacgagaatcctaggtgctgcaatctttttgcagtccagcccatgagcgtagcgactgggctgtgtttttgtgctatttttctgcataattaattaatttggtttggtgtaaaatttagtgaatttagtgagaattagatagaagctctcctaaaaggcggcgttatccagtggaatatactactagtagagagtatatccaggtgactacagtaacagtttatatttatttcaaacagacatttatattactatacgcattgtttgttttttttttttttttttttttttttttttttttttttttttttttttccgattttttttcaaaacttaacccccatttataaaaaaaaaaaaaaaaaaccctgtaaaaaaaaaaaaaccattttcaacccccccaattaactgtcaatcaatcaattttttggccattaaaccccctcccccccccccgccccggccttttcctcctcctcctcctcaaggggaccccccccctccggggaattttcctcctcctcccccataaaaacccccaaaaaacccccccccaaaaaatccccccccgtcccccccgtttcgtcgtcgtctacgagctcgttgggcccaaaaaccgggttgggtttaaaggaaaaggccttcagcctggggttgggggggggcccgggccgggggggggggccgggcgggggaggggttttggggggatggggaaaggaaaaaaaaccccatagttgtagtgggggggggtgggagtggaagttgtcccccgggggttggttcccgggaaggaggttttcaggccgggttttttttcatccccgcataagggggggaaactgggttctttaagcccccgggttgggccccaatttccgccccaattttcataaaagggggggttcccccccccctgggggctttggacccccctttagcccgccgggaacccccttgggcccccctgggggcctttggaaaagggggttaacaaaaggggctggggttccgggggggggttccaaaatccccccgtgggccccccccgcggggggttcccccaaaacgggggttggggttttttttttgggggggccccctcgagggggttcccggcctttttgttacccccccaaaaactttcccccaaaaaaggggggccctttttttttaaaggggggggttgggggggggtgtggtttttcgcggggggggcaaaaaaaaaaggggccgcccccctataaaaagggggggcgggtggtggggggcccccaaaaaccaaacaaaaaaccccccccccccaaaaaaaaaaaaaaggggggggtgtgggttgggggaagaaaaaaaaaaaaaacaccccccccaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaatcaaaaaaggaaccaatggtcttataagaacccgaaaaaaatgctagtggaaaaaaaccccattaaccccaacccaaccttttggtgagagaaattcccaaaaatgattcaggtttcattttttttagcggtctcgcttagaataaagggggggtaaaggtccaacttaacggccaggtattataggttaaaccttccatgaaaaaagagggccaaaaaaccaataaaaatcccccttcgggcctggtggccaaaaataaaaaaaacccccggatttcccaacccggggtttttccttacacgggggccacggtttccttttttccccccccggggctttttccacccaaaaaaagttcccaccaaatttttgggccggggattcggcccttttctgggggaaaaaagggcttccggcccgtcaaccaaaagccaacccccaaaaagcccggtaggattggaagggggggcccaaccaaaaatctagggggtgccattttttttccggcccggcccataagggaagggctgggggggggttttttggtatttttttggaaaaataaataaattgggttggggggaaaattaaggaatttgggggaaattaaaaaaaagcttccctaaaagggggggttttcccggggaaaaacttctagtaaaaaggaaatcccgggggcccccagaaccggttttatttttttttaaaaaacaattttatttccaaaagccctgggtgggtttttttttttttttttttttttttttttttttttttttttttttttcgattaatattcaatacttaacactcagttatataaaaaaaagaaaaaaacactgtcaaaacaaacaaaccagtgtcaagccacccaattaactgtcaatcaatcaattatctgccaattaacaccctcctccccctccgccaccgccatctcctcctcctcctcctccacaggaaccaccacctccgtcgcaacttcctcctcctcccccatcaaaacccccaaagaaccctcctccaaagaatcccccaccgtctcccccgtttcgtcgtcgtctacgagctcgcttggactcgaaaacaggcttggattcaatgaaaatgacttcagccttgggcttggaaggagaccgggacaggacggggagactggcagtggaagtgttcttggtggatcgcgaaaagcagagaaatcccatagttgtagttggttgtagttgtagttgaagttgtagctcaggtgtttgataccgagaatgaagtcttcaagtcagtatttatatcattctcgcatcatgttcggcaactcggctccttcagtcgccgtgattggacccaatatccgtcctcattctcatcacatgaggtgtttccacctacctatggtcatctgaaccacctcagtaccgcccggaactccctacggccctccctgttgcctctcgataagcggctaacgaaaagtgcttggttcaccgcacggctactcaatcacgcttggtccaccgcacggctactccaatcactgctatcgctttcttatctgagctacatcagcggttccagactctgtaaccccgaaacttccccagaaacgggcctatgttcaagcggctaaggcttgttttacaggcaaaaaaagcagactaaaaagcagtctgacaaaacaaaaccacaaaaaaagtatgaaaaaacacatccagtgtagaaaaaacatttcaaatacactgttggtcgtatcttaaccgcagatatctacttttgtcctgctcaaatcgccccattcgtcgttctgaggcgaatcgcaactccctcccccggatgacgtcattgagagactagctccaagacagtcttagccgaacgttcagtccccggttatcggccctatcacgcactatagaaggccccctcctgcgatacaacttgccgtacaaagagcgactccgaattgccatctactgacaaagccgtttcggccgagcggatccaaatgtgaaatcgtcagtttggaacctaggttggatgtgacatttgcagatgagacggagtattggtgcctcatgaccatgttacaaccatctacggacacgttatctctggttgttccgtttgtctctgcaatcagcgactttgacagcagctgttgctgaagttgaatactgtgctgaagttgattgctgtgcaagtgctcgcaattgaaactatttccggtagccaaatcaccaccaacgtccggactgtgaccaactgcaacgtgatatagaggagctgtgtcaagtgttcggacgacgaaagttggcatggagtagaagagagcctggatgtagttctatagggtagataagtccaggtttgtgtgtacagtttggatgaatccatgtacttgtactagtaggcgcagtaccgaacaatcccttactggctagttcagatgtccttctgaagaaaggaatattcagataccacttgtgagaaacatcaaatctgaatcaacctgaatttgtatctcgtcaatttcactttccctctgttccatcaaatatactcctgggtcaacaggaagagtgaactaaaactacaggttgagctccaaagaacgtgtacaacgacttttaaatgaagctgcaccgttgtagattcaccgagttcagcttatgaagacaaattcgtgaacagtaccgttcttggacaccacatccactgtgaatggcagttacctcaaccactcaacccaaaaaacgatggtttccgttcagtactatccgtactccctgtaggagctcgccaaatggtggacaccgaatcccactctagaaacatcccggactgtttccctgcaagtgtttcggctctacttaccttaggcaaaaccactatagccggtaggcagctctctcatgttcccatgattggttagtcgtcttgtcgccagcagtactcacattgttagtaagacaccagtccagtttggtaaatcttggttcggtctgcgctgaggatcagcagggagcacacacacttgccatttcccagaagtaagtcaccatgttccaaagatgggttggtatcaccaaacaagtagatagtctcattaggtcggatcgtcaccaaaaactggtgaatggagacctagacattggtgacaaaccactacaagtagtttcaattcggaggcacaaattcacccaatggattttggtcgacctgattgcgtgctcagtcgaatcctccattagggtgctgagactctcctgataagtccctctggtagagaggggagtatggtttatcgggacgcctcccagcaagtgatttgtaagttgttcatgtatttgctatagaaaatttctttttcttcctcgacaactgcctgtgacttcagttactgtcgagatgtgttctaataaaacacgaccagacctccaggaacctccctggctgtgttctactatctacatactctgatcgaagaatgaatttagcctggatgtcatctctgagagtccctcaggatctacgatcaagttgcgatatgtttgataagcgataagcaataagcaataagcaataagcgataagcgataagagataagagataagatataagcgatgagcgataagcgataagacaatcggagtgcattatctaaactctatcacaagaaccgactacactagtgaaagaatctaaaatcaattaacaaacataactatcatcaatgggaaatggaattttggacacattatcaagaagaaacgtgctgaagtcgagtgtcgattcctatcgccggtcacctcttaaaagtaaggagaggcctcaacaggagcaaaggagccgtaaactcgaggggcaaacttgacctctcctcggttaaggaactgcacctctccagcaacgtctcgaggagcgtcgtagtcggtggtgatgacagaaacggaagcgtagcatccccagttggcaacgacatcagactcatcgggaagaatacaatctccgttaagacaagccttggaggcctcggagttggtgattccgggagagaatcggttggtggtctcgttgtaagacagcttgagcacaatggcggcggggccagtctgtcgggtgaaaattggcttgatctccttgcactgtccggtgggatcaacgtcaccagctcgggggaggttgacagacagaccaactccgtaaggaagtagagtggctcggtccttggcgttcttgaccaggttgttgacaataccggtggcggccttggcgtagatgttgtgggccgcgttatcggaggtggaggcgttggcatagtactggtggctgttcattccactgtaagcaatggcaggaattcctcgcagaacagccatgtacatggcaccgttggttccggacatggtgtagatgttggggccaatgttccagccctcgttgggtccagacaccaccagatcgacagtagcgttgttgaaaagacgggggatggcgtagtcgaggccgaagctcatggcagctgccggagtgccgtcaaagtaccagatgtggtcgtcgttgtcgtcctggccccagttgggagctcctacgggaatggagccgaactctccgcccttggtgaggttggcggctcggggaaggttgaaggtacctccagttccactctgctggacagcaggagcaaacatgaacacattgtaaccctccttcttgagctcagagtagagagatcggatgttggcggaggcccacgagtcatcgttggtgacaatgatggtggtgttggagttaggattggtggagttctgggccacggcgcaagacgccagcaggggcagggcaaggttggagaacttcatggttgtagtgtgacttgttactgggctttgagagagatctacatcggtttatatactctacttgtcggctcggatcagacttcatggcagacatccgttgagcctagcgcattctagattggactaatgcagggctggagaagtggaccttgtggagttgatctggttgtggtggacagtacagtactgtagtaagtattgtagatactgtagacctatatgagcccccgaatggtctgcttagtcacaaacggatactacagtgatggctactcctgtatactgatctacttaccaactactacaaaatcaacttatcccgaatatgccaataaaaccgtgtctaaaaccacgtgcaatattggatgtattgacaagacctattgcagctctattgacattggcataactctgaatccgtgacataattccacattaagcggagaaagagccattgaactctgtcggagatgtccgctatacgagaggatgcggtgatacgagcgccgttgcaagtagttgccttgtatctgtatgagggtataggaacattgtagatgtatcaacaaggctcattttcggaacttttttttggttctactgacaccgccaagaaacggaaaacgtgtctcccctgttctcaccattggtcgttgattttccagctccaaaactctgattttctcgtcgacaatcggtgttttaatctggcaggtcagtccgtgtgaacgtcgagaaagataagcttcggagtccgcctcgtgacggtaatagaaaggtgggcagggccaaacgaaggaagatgattgtaccaatgagttctgtttatcttggtgattcgatttccaaatttacagatgtgtagcttgtcaattgagcgtttcagagacacttttatcatcgcagttaatctcgccagaatcccaattaagcgagatgaaaactctaaacacccgcggaagttccgtgactaaagccgttttcggggttcacagacgttgaagtttgtttccctcgagagattggaactttggagattctttctgtgtttttagttccagtgtgaggctcatgggtccaatggagcatgcgggacccaatgcagatgtaaaagataacttagcgtcttccgcagtacatacagtagcggagatttgtgcctattaggcatccaatagtgcagatgagcggagcagagatcgacaggctgaagacttggcgacggtgaagtttgtgatttggtaatttcgttctgggtttcaacagtacatacagtaaatcggcatgtttgttggacgagtgctgtatcacttttgacctcttcacttctcaaatgagtgctgtaccacagaatctcaattatctgatgtcaatctggtcaatttccgtgcttgtacaagagattaagtgtccaacctatagcaattacgaaatggggaaaaatggccagagaagcggaaaatatcctgcaatttggctgtttggctgatagaaagatgtcaaatagaaaatggatcattgatttagcaagatattccagtttgctactttcgttactatataaacttgtacaatctacgatgttgtcttactatcgcacgtaacatactcgcacttgaaccgtgccgagacttcagaaaagcccgtaaaatggtaacaacgaagcgataatggaagaagtaacttgttatcatggcaactgtgtcggtaattaactggtcctcggtgttgatgagatgaaggcttggatgataagtacaagtacaatatctacttgtagttggttcgtcttgtttgcgacattaatagtgaccttcaaagacaggagacttactgtgctcgtactcgtacaatgtgtacaagtagtgctgaacttgacttggcacaatcatccgggattcgaagtcactccagctccatagagacactattcgagacagaaagcattacagagatttacataagaaatgtaattgattgatctgactttacccagagaactacaagcatatggcttctcttcgtgaagccacaaggctcaggagtatgtccacatcgagtattgtggacatactgtacatactgtaattatggtgatacgaaactgtctagatatcttctttggtgacggaattataacgggaagaggcgtctacaggacaaggcatctactggacgaggctggctgtacagctcctttagtaagagatgacaacccgacagagcagtgtattcatgctttttctccagtcgctacaggaaaaactaatcgatactgctggtctggtagttgcgataactcggagacaacgcccattagacgaactcccttgtacatactcgtacagacattgtactagctccccaagacgtgctgccatagcccgacttgttcacaatggtttgttcggcttactcctgtgactctttggatcgtcggtataggtacagtacatacagtactctgaagataaccgtccccaatatcacaacgtgtcacggcgggtttcctcttgatgctgaacggagattttgctcctgtttgtggaggtatattcacctgagtcctggtctgaaatcactctatccacttctccaatggtgtaactgacccctaaggaacctccgacaaacaaccaagtgattaacaccaagtgatgaacacccaatgaagaacacccctagcaagtgaagtgtaagtcggaatatcctagcaagtgataaaaccaagtgatgaacacactacccagtgatgaaaacactaccaagtgaggtgtaagttgttaattcctatgatactatcacccactacgatccatgtgtatttttgtgtatttttgtgtatttttgtgtatttttgtgtatttttgtgtattttcgagtattttcgagtattttcgagtattttcgagtattttcgagtattttcgagtatatttccatatttaatccacacactgtacatcccagtctggtaaatatcatactgaaaaacccaacgccatttaaactttctcaatgcatctggaaataccctccaaaacaatcaataatgttcggaaagagaatttaaaacacgaaataatacaccacctatcccattgagttcgattctcatatgatatcagccataaatcacgactgtaaagctccacgtcgtgccgccatcccggagctaaatttcagggggtggaactctaaaaccatataaggtttggatggccaattttctgtggaaattgcaaatgtcaataagagacagttaaacaagacgaaagcggcgtggcaggccaatttcgacgctagataaccacgtgggtccacattgtgcaatttggggcaatttcgacttttctttaatctggttgcaatttcatcaccttattttcgacaagggccaaaattgaagataagggccccggttttaatgctacaatcaatctgagacattggtggaaaccgttatggctgtacgattcttacggtatcaatattgtttggtttctgacccgaattacgcaagacacggatttttttgaataaagaaatagatgaagtcacagggcccagaaagtctcagaccctgggaaaagtaacaagagcagaagtgaatggcatcttcttaaacaatgacacacttttcatcgtccttgccctttcgtccgtgctttcgtcctccctttcgtccgttcttggtgaaggcattgtcggcacccatgggtgtaggagcaggagcagagctgggcatggcgggggtgttggagacgtttcggcgggcagcatagtttgcggcattgttagctgagggagcggcgggcaaggagggggtgttggccgagttcattgtagaagtaggagcggtggagttggaggtggaggtgttgagcgactgggtgttgactgagctggagacgctgggttttcgcacgtcctgggttgtctggtagcctccggtgtaggaagaagtgggggagacaccggggccagttggggacgaggagagcatgggctgcggttgttgctggaatcgtttctggggcgcgaacatgagcacgttgggctcctcgtcggcggccaacagtttgttggcgagataggagtagattttgatccaggcggtttccatttccagggtgaaggagtctccgaaccggtcggcaaaggttttgatcatggcttctcctagccatcggtagtggatgggttcgacgccgatcattcggttgtgtcgttttcccaccgaccacaggaattcgtccaacttttcaatgtggtcgagcgacttgatggcgagtccaaacacgcctgcgaccgccaccgattgttttttgatggaagggaagatggacgtgagctcggcgtgggatgccatgaggttggtgtagaactgttcgcagaagagcgccgtgggtgttccgtaggcggcgctgctttcaagtgtctcggggtcgttcatgagctttgcccacagctctttggtcaggttgatgtcttcgcgggtcatgttgaagacgacctctgccttggacggccgtgccgccgaatttgtgggggtcacggcgccattggttctggtttctctggcgtcgttggagttgaggtggaactgctggggtgccgtggacgttttgaccggctgctgtgcgtacaggtgcggtttgattgtgtagaagtctcgctgggactgcgagtatccgtcaatgtcggccattttttcgtgctggctgtggatcgagtcgtcgcggacgtgcacacccatggttcttaagggcgaatttgcagattgactttgatcggctgcagcagccattcgtcggggaatcagtggcaggttggaaaagcggccgagagcggacgaaactgacgagattgacgacgttcgggacgacggatagaaaggtgcaagcggcggagtttccaacggcggagtttcaaacgacaaagtccgtcttggtggcggtgcggctagtgcggtgtcagcgtggtatctctccccgctctccttctccgtcgtttctgctgcttcgttttgctccataaggttttggtgagaccgggtcccttagcagccagtcgccgtgggggctagtgagtccagggacacgtattatatatgtcagtttgcaaaaagggctagcgagcgggtggagggtgagaaaatcgtggtggagaatcgaaaatctcctcttttggcgctctgcatctgattcgtccttgtcgaacgtctaccgaaccggtcggaaagctgtttgtcgcccacacgtgaagtcaacatgacccatgcaagactgggccttgtgggccttttgctttggatctactgtgtattcaaacgtaatcttgctgtggggagacttgtagttgacagcgtttagtcgattcgttggttgagagcgtctgaccgtcatcagtgtcgtctgaagaaagtgctatagcagcgctgagtggccgttgaataaagaagcttgtcagaaatgagttggagttggactgattgtcggtttgagcggattgaaggctttacgtgggatttttcgtcgttgacatgtcatcaaactgtctccaagcccctattagtgccactaccacctatgtacaagtacaatggtatcatatgaacaagtatattgtacttgttgtacttgcaaaattatcacgtcaaaagaattgacattaaagaagtcccatacaagtcaacacgaaaatatttgaacgaatacgaacaggaacgaagccgaacaaattgaaattaagacagatttcaaagattcacagattttacaggttacaactacttgtactgtacttcatttgtcattctccaccgcatgttcattacaagcaccgcccatccaaataaaattaattaattaaatgtaagaaaagtaaattcacaaaacccaacaaaaattaccaaaaaacatcacataataaaattgactcaatagaaaaaattacagcaacagaatcgacacagttatgagaagaaaataatcgcaacactaaccacagaccagtagatacgtactaccactaacaatactgtacttcttctatagccaaactcagagccacggtgtaaaaacgtttgacccctcacgccacaataaacagggtaacagacggcggttgcaggcagccccatacgggtcacgtgatccgaacaatagcaaaaagaccgccgcccttgctgtttaggtccttggcgtttttctgaaagcgtcttgttggctccggttctggctctttcttgtatgtttgggtgacacacaataataatattaaaaagaaaacaaaaagaaaaaaaacaggggtaaaagagagctgaacgtattaaggttagagtgtaaaccttattggtgattggggttgttggaaattagagttgatgaccgagttaagcgagaaggagttacgagtggcttaataattcgcgatttgatggcgattaaagggattaattaatcaaataatttaaataacggcaataaaaataaataaatatcgaatatcgaaaataaatgtatatatttgaaatcgtgtcatcaaagggaaaagaaaagggggcgggaaaaaccaacagagacaagcggacaatccagctcgaaaccagccatcccagccatccctctttagactcatcgtatcgtaaaccgtctttgttgctgtgcttactcagcacgattgccggtttgagttcgccagatcttcacgtgattgcttgctcaagacacgtatgatgctccggggttgcatttgctatcggagggtcggagaggggactgtgtgcgaagtttgaggcatttttctgcgaattatggcgaattatggcgaattattgaggctttaatcgttgttaatttgtcaataattccagatacttccaaaacaccacgaagcaccgtcaatcaatacacaagtggcccgcaagttcctgttccgacgctgcaaaagatggactagcagtacatcgctgcttgagctgcttgagggaaccatgggctagtcggcgcccgcagcagagtaatccagcaaactaaatggtgccgtgcagttcagccgtctatattgttgcacaatagggtatcataccggcagccgagccgggcgtgtagttttttgctgtttcggtttttgcggtttggttggtgggattttttctttttcaaagtagatttgcatagcctcgtttgaagctggcgaaaaatacgatataaatgcggattaattcgagacggggcggtttgaggcggtttggggcgggaaacgggccacaaaacccagcaaaaatgaacttggccgtgggatttgcttctaaagcacccattcacatcagttttcacgcaatactcacatgccaagtgtactctggaactagtattgctgcacgtggaacttcagatagaagctttggaaactcaatatcgcactgtatcgagcaagatatagtaatgtcgggaggttctgaaaggagtcatgcgtcgatgaaggtccagggtccgtctcagacacttgggcgtgatgtgtctggtggttctgagttccgttttcagccaggtgcgtttttggacgtaaattttggagaccgctttgaacgtgactgcttcggacgtgactgactccaacgtgactgagagtgaccgactccaaccaactcgagttgtatgacaataataacacatgaaaaatgcacccaaactaattgatccactctagtcgcagttgtagtcggtcgctcgtagcactcgggctatttttggacatatgcactcattgacagcacatggcatgacatattacggcgtgttatggcatattatgacacatgtgcgatactgaaccccccgccccaaactagtatctctggtgtgaacaagacacagaaagcgagagtgatggttgtgatcattcggattctcgtcgtcactacatgttccgacggggccacacattggggctaatttgattctcggagacgggatgcgaggatcgctcatttaatattagccttctatttatagccccgcacgtcaccgagtcgaggttggattggggtctggattgatgttggcgactgtgtgtagacgagctggacgaagccgacattcttgacgagattcttgctactttgatgtctttctgaatctcccttaccctccgttttccatatctcctctcccatcaaaccgatactgaataaaaatacaagtttgaaacaggggtgctttggatgcttgtgaaaagtatgcgttttggggatatatcgccagagtcgatgcggcaaaagaccgttggaacgccggagacaaggccggaccaatccacaccgccatctgcgacttgtacgctcgtctcaaacggactcttttctcgtcgcctccacatctccgcttcctaatccagccttttgccttttcgctcttcccgcatattgtgatagggtttagtgtggactggtagtaataccaaagcgagaaaaggttgttcaaaaagactaggtgcaagacccaaaaaaaaaaaaaaaaaaaaaagaacctgagctccgaatagtcgacgatactggcccttctagtcacacaaacacgcccggtcaccgcaattgccgtccgtcttccgcttccagtccgtttgtttcgtccacgtactccaaacccccgcttttccccgtcctcacacgcctcctagcagtaccacttgtacgtgcgtgcttgtgcacacatcccaccattagctgaaacccgcttacacctgtacatttccgcccccaacctagcgagtcggactttggaacttgactgacactctgtgacggaccatctcgacaaccgacccacgacagccgccctgaagcccattctcacggcgttgtcgcatccaacggtgaccactgcgcatctcatctcatcaccacatcactgtcgttaagcacaccacactaacacccacacggccacaattccgtcgctgccgccgtcaatcagcccaaacagacgccgttcgccaaaagacagccgcccaaccgaccgactatgtccgcgagaaccagatccatgtctccgggccgccctctgcgccaacaacaaaagagcccctacaccacccacagccagcagctccaacagcaacacctggcgcagctccagcagctgcaacagctcaatcagcgcttcgggtcgtccaactcgtccttctcgtcgtcatcctcgcataccccgacccaaccgtcgtcggcaaactccacccactcgtcctcccgccactcggtctacggcacccacaactacgcttcctccgatgcgagcttcaacaaccggtccgtgtcgcaaccaacactgtcggaacccgccaccccaaccacagtgccagacagataccggcgcaagagcatggtcaacctgccgtcccacgaacgcagcccttcgctgcccagtaacacaaaccccggccaaggttctcacgtgaccccaactgccggtgctgctcaaacctacaccacccagcaagctcacaccacaaataaccccaacaccaataactcgccgcctccccgactgtcgtactcgtccacagactcgtctgcgccctccaccaccgccgcctccacctccaccatcggcaccgtgcattcgttccacaaaaagacccaaagcagggactttgacggtgagtatcacaacatggaccatcatggcatgcaccatgttgcagctccacatggaccaaccctccacacaaccacacacagccgtccatgccctcgtactcccactaacgcagaccaagcgccgtcccagcagccgccccagcatcagccccagcatcagcccccgccccgacaacaaccaatggtgctgccgtcggatgcccgccgaaaatcgctcctggccaaagacccgctgggcacactgcaggaccagcgtgcctctgccatctcgctctcgtcctatcacacggtccagtccaactcctcgcctactcgaagcatgatttccgacgacagcagagaaagctcccctgacgtgagacaagacaaggtcccccaacccgacacgacccatgttaacgagcacaccaccaacacagaaaccacacagctcggcgctgctcctccacttgccccaccagcgtcaactaccacctatgaggatgctgtggccgctggagttactgccgcgactgcacctgccgatgcagaccagacggtcacagacgcgcacacaaacaccgtggatgcccccgttgttactcctgcagacacaacttcgcactctaactacgacgtggtctctgcacagtacgatgctcccccacagtttgatgctccgccggccgctcctgaaaataacgcaacatcctctttggaccctgctaccgaaagaggacggtacagagccaagcactcccctcctctgtcgagtcccacaaagacagaggcaccacagcaacctcaatacatgactcagcaacagcatgtatctcagttgcagcagcaacagcagcagcagcagcagcagcagcagcaacagtattcctcaccacccgtgagccagccttcgcatcagcagtcgcagcgcaccatgtcactcggcagccagtctgcattccgcgactttgaccagcccttgtaccagaccaagtcaaacatgtcgattggtggcaagtctgtcggcggcttctcctcgtccgggattagcacatccggcatgagcacacagtcgtcgttcggcggtctgcgtcaccaaaagtcgtcaggctcgctacgagagaagttcaagaaggtcttctcgtttggtcgtacaaagagctcattgagcagtgcccctacttcaggtcagatcaacctcactggcggccccgcccagcgatccgagcgaacgtccactatgacatccacgacctcgggacgttcattctccgagtttctgcgccggtcgtccaagcctgacaactttgacgacgccaggtccatcgagagcaacaaatcgtcgtcgtcgtttgcggccctcaagcgcgctggcaagaatcttctgaagaagaacaaccccaccgagcaggctcgaacccccaagtcttcttcccacagcgcgtacgatgtgcctactgcggggtccactggccgtgcgccttctaatgctccccaaaatgcaccttctcgaacgggtactccttcagcagcgccttcgcgtgcagccactcctacccccacgctggcttctggttctggctttcagcctggcgtttcgcctcccaagaacaccgctacagcttctttgtcggtttctcctgcggaggttgatcgagagacggcccagtggagtgccggttccagtctggagggtgtgcttggtgctgcggccgcagctggtgctacgcaggctgcgacagctccttcatcaggctacggagtgtctggcaacgctgtcgttgctgagcctgctgtgacggagcctgaatttgaggatgcccatgctgcatttgatgaccagtctgctgttcctgcaagcgcttccagcgatgcagcttccaatattgctcctcctgcgattaccaccacgctggctagcgcccttccttccgacgcctccagtcccacgtctgtgtcttctgtcaatggcggttctgctggatccgagactgacgccgacgagtttgtggctgccgaaacggtcttccccaaacaccttggtgttgaagacattgacaacattcgaacctctctcgaccgaaccaagtcgctggagcgacgaggtagccgacgacgcaaggtgacgcccgactcgcagtcacatgcccatcacgcacccgaagaggccgtgcccaaccctacagaggtacacatccatcatccaaagtcctcgctgggccgatccgaaagtacttccagaccccgaagtattctcaagagcaagcagagcgatggatcgatggttagcgttgatactgtcaccggccagcgtctgagcgatgtgagtggcgaacgagtcagcggtgatgtgtcacgttcatcggtggaacaggtgagcggtgatgtgtcacgtgacaccatcatttcgacacgtgggggtacgagcgatattctgcccacacgtgactctctgactagtactggccctgcacccatcgacattgagattgcacagaattctgctttggctgaccctgaggccacccccaccggtcttgaatcgttcatggagagtgcccgaccctctaacaacggcccgacctccgaggccggcacagacgtcgagtccatgtttgccaacttctcgtcgatctcgtctgatctcgatctgtcgttttccacgcagctggagccgcttggcctgcctgtgcgccctgagtcgcctactccttcacaacagtcgtctgttcgctccacggactctgcttctgtttcccgtttcgccaccaagctaaaggacaacctgttcaagcgtaaggagtcgaataccggcttcaaccccgatttgcatgagacgatcagtgaggactcaaccgaccaggaccatctgagcggtctgggtggccacctcaacgaccacgttcctctggagggctcgctcgaaacggcctccatcacgtcgactgaaaccccttctatcactgaatcgttccgatccgagggctcttattccgcccctgtgcctccccagatccctggcggccagcgtggtaacgcgcctctgagacacttttcgcccggccccaccccgtcgaaccccaattcgcacaatcggcggttttcggggggtaccaaaaccccccagactgctgcttcacggcggtaccaccagcatggccggtctgcgagctacaacgatgatgggtctcgagctagtggctcacctatcactgcccattaccctggcgtccatgttccttctcccgtgagccatgtgagaaagggtaatgtttcgttttccagccgaatcgtcatctacgatacgtgggattcggacgattatgaccggcgaacggagccggccacttgtaaccggctgaccccgctgttggcccagcagatcaaggaggagttaaacaacttcaagatgaacatggacgttcatcatgagagtcgaatctacactcactttttctaagtggtttccgactccgtttgaagacggaaaatgcatctagtggatgtggaggataaaagtgacaatgtcactcatatgatagttaattgcataattttgatatagtgaatactgtaggtgcatgccctgatacttttaccgatacttgaccgagtggtctttgatcggccatttacgtttcgctcaaacgggccagtgtttcacctcatgggtgtttatctccgtgaaactcgtaccaagcagcaagatacaagtcgcgccggtcttgtagctttctgtttcgggttaaatgtttcgtttctttttgttcctttttggcgcctggcgcctgcgataacgcctcaactttaggtctattgatattagctttaggctgcgtcttttgtcagtgatgagctacgagtagtcgaggtgagaggcggtcacgtggggtggagtcacgtggggtggggtcacgtggggtggggtcacgtgaacacccggttctctgcgattcttggttcacgtaacgagatttgtcgtcgtcaaagcgctgtcaaagcacgtctccatcagtctttttggtgagctataattagtcgtctgggtttggacccttttttgatagcgcttatcgggcattggatttcgaggaaacccgttttgagcgagatgggatccagaaccagactagggttttgcgggggagaaaggcactcaaaaaggcacttaaaaaggcgcaaaactttggctgttcaggtacgagttgagctgtgagggctgcaagtagaggacgccgggagaaggttggaacaactttttaggtaagtttttttgactgagtgtgttcattgccaaaaaactccgcaaaggagaattgaactccggtcccccgcgtgctggtgtaaacctgacaggcggaaattctagccactaaactattgcggatggctttttttaaaatttaaaagctggggatatacctcttgggtttgcttagtcagggaccaaccgacagcgtcccgcagcgcacatcgcaaagattcagaagtgtatgatttattgaacgccaataacccgggttactactgtaggtatatctgtaataaatcattagaataaaaaaatagaataaaattaatataaaaattaaaaattaaaaattaaaatttaaaaattaaaaattaaaaattaaaaattaaaaattaaaaattaaaaaaaagcttaatttcaaaaaatcaataaaagaggtcgaaaaatgagtaaaaacgagtttgaaagagattcgttgtgctttccaactgctggagtacatattcggtccaagttgaactcattccagcgttcccacaaacatctaattatgtaatgtagccaaatcagttttgcaataagatcttgcaatcgtgctacttcttcagaatgcttgagcaacttgattcgaaacggttctcagagttgttgaatctatggaaacctcttgagtgtgtacagtatgtacagcaaccaattttcgagctcgagactctgtacggaggtgtttccgggcacctattactcatgtggaacgcttccttaactgttcaaagtaactggacacctttggatcttgaaaaaaatgcttacaagagtatctagttcaagtggagggcttgcacatgagtatcaatgaagactgctcgtcagagaagctcgccaaaggggtaaaatacttatcaactgctggagtcgcagtatgcacccaacttggtcgttcgaattgaccggcagatgtgattgcggactctgaaacggaaccgaagatgattgcacgctcaggaacctcagtaaagtgtctcggttgtcgggaaaggcgaactcagcctgactatctccatgaatcatgcacttgatttgtacggtgatttatgcctatctgttgtcaccagtggcgctcagctccgaaagaactcgctcccttacctccatttcaacttcccaactcaagcatctgacttgcaagatatcgtctactaagcctgggagcgcataacccgcagtaatgtgccagtcatacggacatttgtggctggttacagagccggagatcaggtccaccaaactcgcagagggaattataaagctgcctgtcctcataaaaagatttccaaattctctggacttgtttccctgggtgtaatacccgtctctgacttcgtcaatgcctctatctggtcgattgatcactttatcaggtgtttccagatccacaatagcccgaaagatcataaggctccgaaattgaaagcagagatatctccaagttgttgtcgcagtgaaatgatgagtcaccaattacaatcatgtggtcgaagtgtggcctgtcccgtggctataagagtctcgtacctcatttgagtgacaccaagatggagtggtgcctcacttgggcagaatgatttctgttccggtcgatatctgtttcacgaacagatggagaaagggttaactcaacatcgtcacatttgataacatcttttgtttcttcctcgctttcagtctcgaaaggcggatacttttttcgtaacacgccagttcatggattcagggtgtattcttcctctgttgtcgtaaacacatcaatcagcgcaggttggtccgccaaacaaacaaagtctgagtgaagtagttcatcttctagttctgctccgactagtgtctttgtgataggcgttgtaggacctggatccattgtgctagagagacggtgaacaaacaccaagacgcaatcagcccagtagttttggatctcctttctccatccacggcttgcgagagcacaatttggacctgagaatatgctctgtggcctggaaagcagtgtaccactgactacctctcgctgagtcacacacgactctatgtcgacaaacgagtacaccatggacattagttcgggcggcaaccatccttgacccgtctgtcctagcttgaagtccctttggccaatggtaagaagaggtttgtactctcccttggtctaatttgcggaaagtgggggtgctcctgttcaatgaaccaccgtcgtagagcctcatcctgaccctcaacctgcgttaaagagtctggatcaaggactcttcctgctgtttctgttaactgataacctcctccagcccggaataggagagttgaagctctcatcgtgggaaatccaacggtattgcctgaaggtatgtctctccgtatagcccccggctttctttgatatagatctctctctcactcacaaccccacattctgacgaaaagaagacagcttctgtagcgacgaggatattaaagctctttcgggttcccactcttgcaatgtcttgtatttctgccttcacaaccgccgctgctactgtacattcttctctggtggcaggaactgacagccgaggtcatgtctcctccacgcgaaccgccggtcgattcgtgcacgtattaatgagctagatgagccgctcttcttcttccttaataaatctgaaatattgtttcagtttcgacttttccaaacggttctccttggtgtgtgtagagtggaagtggaaactttttgatatacaagttgcgaacaagtcaactactgtactgtagtgtactgtagttctgccaagtgatattaacagccgttcaactaatcatttaacaagaagtatcttgaacaagttcgttaacaaaccctcaactaagctcaacaaaggtatagtacagtttcatgggactatggaacacaccgtcaacaggatattgatggaaaaacctcctttttgcagtaaatctgtaatttaaatgctaaactaacactccttttgaactccctagtgtgtttttactgatggtagttgctgggtggtctcaccttctgtccaatgaccaacttgaccccaatcgatactcggttggagagtaggataggtagtaggataggtagtaggatagaaagtcggacgaaagtcggacgatctctctcgaatcacctaccccgaagtatgtgagtatcaagctgctgaaaatgattagtaaagaccaacatgcagcctctgcctgccttcgatcaagcaggttcagggccatcgtgaatgggtcaaatttacgagggtgtttgttgaaacatggacaatatcgaggaatatgagtctaggaactgttgaacctttctctgacttgttcagatctttttaggaagaggtctgaagttttccaaggtaggactactactgacgagtgtactgcatgtacttcaggtactattgtacacaaatgatacaagtacttagaaccagatagttagaagttgggcaccgtgtagagattgtaagacgcatgttcacatcccgatcaacctcctttctcctcttgtttctgaatcacgtggttaaagtggagatgcagtatcatcacccagttcaacctgcacaacacgacgacaaaacaaacatcgtcggcaaaagatcaaaagatcaaaaaacatagccatgcgagcaaaacatcgcccgatagatattccacgatccactctctgcattatgtacaaatatgtgcaaatatgtgcttctgtgacaaccgtggatgtgttattatgtggcactcctgcactccactgcacattcgtggacagggttggtgttgcgatatacaagtatgtactgtacatgactggtggagcacaagagacgttgatatgacgagaaaggagaagagtccagatttggtgcgatatttgtacaaatacttgtatttgcggggtttgctggtgttttactgtacaagagatgtacaagagtagatgtatgcatgtacatatatgtacttctactcatgctagccctacaagcacagtatactgtacaacaccgacaaacaccctcctgactccacttgtctcacttgcacaggataacaacttgacgagacgggaaggtaagtgccgacacggcaaggtacaatactgcaccaatatgtacgcgccggcttgtgcatttgtcgccatgtcttcgcctatatcttcgtttctcaaccaaacttttcacgaaacagaagagacacgcgaaacacaaccatggaacagatattcaactgtaatcgaaccaatctctgtggacacacctgatatcgcacggttcattcatgaccctcaccagaccagcacctcccctcacacgacgtttcacacatgcaggggtcatgcacatccatctttgtattcaggaacgggaggcgcgagggttgatcgatttacgaggacatctgaaacacacagtggagttagccggattctgggaccctggtggtgtcttctctttgggtctcttccgagagtggtttaccgcttagtcataccaaccacgtttgagcgtcgagtctcgacattgccatccacaacaaccaacctcaaatgaactaatgaactgataagaccgttatcaacaagacgatgcattgtctcccacacctggtccatttcattcagcacccctggcttggcggcgcacatattcatcacattggggacatttgctgcagctgatgccaacaagcaaaacggaacaggcgagttggatgaggtccagaatatataaacgagcgcaaggtctcgacaatatgatcctcatccacatcaacaaactccccctcaccccagtcactctttcatgaaaccctccgtcattatcgcgctggccgtagcctgtatggccgcccccatgtctcctcagggagcctacaaggacgcccttgacatcatcaacggtcaagcctccaagttcaacgatgcgggtctcaaaaagcgccatggccaagagcccgataccttcaacgtcatcttcaaggacggtgtttccatcgaccagatctccgagcatctgaagctgctggacggcttgatcaacaaggactctctcaatggaatcaagaacgcctttgatctgccttcccaaaaggacggctccggcctcatgggctacagcggtcactttgacaagagcattgtcgaggcgctcggcaagttctccgacttggtcaccatcgagcaggaccgcgtccagaagcttcccacctttgagggcttcaagtccacctccaatgtctatgagagctcttcctacggatccgactggagtatgagagacgactttttctcctggtggagaaactccaacacctggggcgactggtggtacgctcgaaagcccgatacccagcccggagcctggccccagcccaagccccggcctgagcaacccgtccagcctattggagataacccgacttctcctgctcctgctcctgctcctgctcctgctcctgccaccgaggagcccaggcccgagacacctgcagctccctcttctcccgccacctttcaggaagttcccaccaagaactggggtctttttcgagtctcccacaagcaaaactcccgtgaccagacccagtacgccatgaacaagaacaccctgaaccccactgtcgcctacattgttgactctggtatccgaacctcccaccgaatgttcgagggccgagcctcctggggagccaactttgctgacaactccaatgtggactttgagggtcatggtacccacgtggcaggcaccgtcggaggagccggcttcggtgtatctccctccaccaagctgattgccgtcaaggtgttctctggaaagtttggaagctcctcccagatcatgcagggcgtgtcctgggccattgatgactacgtcaagaacaaggccaagtatcctcgagctgtgatcaacttttctggtggaggagacacctccgaggccgaggacgcgctctttcgaaaggctgttgagatgggcatggttgtggccgttgctgctggtaacgagaactccgacgcttgctacgtttcccctgcccgagccggtgctggcaccgccggattcatcactgtcggagcctcctccgccgacgactctctcgccttctggaacgcccaaaccaacaaggcctccaattggggcagatgcatcgatgtcattgcccccggtaccgagattctttctgccgactaccaaaccgacaacggtatcctttccaactctggaacgtccatggccactccccacgtggctggactggccgcccagctgatggctacctcgtccgagctgcttactcccgcccaggtggaggagcagatcatcaaccagaacaacggtaagatcacaggaagactcaacggtacccccaacaagctcgcctacaacggctccggtcgttaggttggctagttggatcactgtcgcacgcagttcaatcaatcaataataattcttagtttttgtactgtagcgtagcatcaacaggtgacaagaattgcaagtgttgtagagtcgggtatacgaaactgttcttgtcaaaaaatgtatgactaaccctagctactttccttacaatacagtatgaaattaaacagctttaaaccaccatttccagcttcagatacgatatttagtcagtctgataacgttaccgacaacagaaatgatcacctgcgaaatacaatatcacaacattcctgcggagccgtttttacaactccaaaagataacaatttatctgcataaaacccgcatacacgtgcataatacttgcataacgatagcatataaactgcacgattgctgcacttgactttatatcaaactcaatatcagcaccacccgattctctgattatttcatcaactataggagagaatgagttggtgataagacatcggtaccaataaaaatcacgtgactattccacaggccttctgttatatcatcagatgcctttgaacattctcttgtcgaactgagtccaatttcaacaactctttccacagtgcccggttaggccaattagggtttggcaaaaatcggcaatataagacagcccagatgtgtttctacgatggacaaccgccagcacttcacgatgagcgagagtagacacagtagcaagcgtaaaaggcggccgaggccaccgagagaacagcgtagcagggcgcgtagtcaccacaggggacgcagaaccaaaccaatgacgaagaagaaccacaaggagacgttttcaaaggcaatgcaaatgaagagggcaatggaaggatggagattagagaactggagactggagtggcgttttcccgatgaacgaacaaacacgcgaagctatgtggaccaacatacaacacggactgaaccaggtttttttatgatttttttactggaaataggtacgtgccaagttggaccatgacactaaacgtgtttaattagtaatattcgtgtaagcgtacattcatttcaaaggttattctttcatggcaaagttataattaaatgaatgtatatgcagaaaaaaaaaaaaagacagcaaactaaaatttatataaagcccatcgctgccttgttggagcctcgttttttcccacaacacaagcttagcagtaattgggtcctctattctcaattgcacgttccccccctctccttacaattcactcactctcccgactatccaacaacgcacgacaaacatggcttcaattccccattatgactatctggttatcggtggaggctaagatggtgtagcttctgcttgtcgagccgcctcgtacggcgccaagacgctgctggtcgagtgcaaggcgctgggaggcacctgcgtcaacgtgggctgtgcccaaaaagatcacgtggaacgcctccgatctggcgggccgaatccgacaggcccaggagtacggcttctccgacgtggaccccaagtccgccgacaactttgactggaccggattcaaggccaaacgagacgcctacgtcaaacgactcaatggcatctacgaacgaaacctccagaaggagggcgtggagtacgtgtttggttgggccaccctctacaagcaggagggtcaggagttccccctggtactggccaagagcgacgatggcaacgccaagttgtactccgcaaagaagattatgattgccaccggcggcaagcccattctgcccgacgtgcctggagccgagtacggcattgattcagacggcttctttgctctcgagacccagcctaagcgagtggcggtggttggaggaggctacattgacgtggagctggccggtgtcttccacggactcaactccgaaaccacccttttctgtcgaggccagacggtgctccgagcgttcgacatcatgatccaggacaccatcaccgactactaacaagaagggcatcaacgtgctcaagggctctggcgtcaagaaaattgtcaagaaggataatggcgagctcacctacgggcaggatggcgccgagaatgatatcactctcgattcgctcatttggatattggacgagagcctctcaaggacaccctcaacctgagcgagtttggcatcaagaccaacaagcgggctacattgaggtctacgagtgccagcaatcgtctttcgacaacatttattcgcttggagacgtttgctgcaaggtcgagctgaccccacagctattgctactggacgaaatctgtccaaccggctgtttggtcccgctgagttcaaggatcagaagcaggactacaccgatgttccttcggccgtattttcccaccccgaggttggctccatcggcatcacggaggctgccgccaaggagcagtatggtgaggacaacgtcaagatctacacctctaagtttgtcgccatgtactacgccatgttgcaggagaaagcccctaccgcctacaagctggtgtgtgtcggaaaggacgagaaggttgttggtctgcacattgttggcaccgactcttccgagattctgcagggttttggcgtggccgttcgaatgggagctaccaaggccgatttcgacaatgttgtggctctttgtcccacttctgccgaggagctggtgacaatgggatataccgggagcgcggcgagagatttctctggtttgggctatcgatatttaatcaactagactccactgttgctgtcacagggtcagagaagatactagagtacggaagtgcgttccgttggctgttttaatcgccaaacggtttgaatatggcataaaactagtcttgtcctgtcggtttcttttccatgggcttcttttcccacttgttgaatgttgatggcgaaatgaagacgggctagaaagtggagagacaagaggaagttgcagaaaagttcgatcagcgggtcttgcggttgagggaaatatccaagatacggtctgggtcgtgggaacctacatataagagggctggagtcctggatagaacaagtcgacacatttcaaccggcccatcatcgttccgatgaacttcaaacatcttccagttttctaccccgaggaggcgttagaggtgaaggacaaccccgagtttgtcatctgtcatctgaaaagtgcttcaagaggaaaaagtactgccggaagcgacccaagaagaagtgcttctagatggagcactccgtcgcctggagtagaagtaactgtagcaataactgttgaagtgacagtaactgatcagacattgatcatacgtgcatcagaactaccctctgttaactgaatagcacaagataacgtcatatcgaggggatgagttttctgtgattgaaaccagtgttgtcggtctatacatcttgaaaaccttccaataggtgagggctacaagtatgtacatactgtctctgaaccctcagtttgaaccgtgagtacgctctttaaacgcccaggtgaaacgaaagaagggaagagttaggtcctttgggatcccggctcatattcttgctcctaatggctgtcaggtgagcaattccaaactttccatgtccatatcgcagccctatggtgttttcagcctcaacattgcgtcgtgccgacagaacgactactgtcatctccatatgaggaacatgacagaagagaatgaagaagaaagagaatgtagccccattccagtgtcgtctctgttcagagcggaaaagtccacttccaaggaatagttctcaatcacatatcggtatgtacagtacgtaccggtacggtacaatcatgcttgaggctgtcaacaacagaaatcaacagcaaggatactcgaagttatcccacttctcgcaagttccacgagatcgcttcagcatcatgtgattctacacatccaagtcctctgtcgatattggggctgttctccgaatgggtccactgcactatgacactggaacgaccgcccaatcaaagaaaactcattcggagccatctcattgtcgatagactgcaaaacccactgctgaagacgacaagatgaagacttttcaagtcaaagtcgatggtcgcttcctctcaccttgtcttgtcagcctcaatcactttgcttccgagtctgctacttcatcagtcacaactgaaagagcccctcttgttgaaggaaatataaagggcccgtttctgaacagtcctcgaactccaacaacatcaaccacgccccttttaccctttcaaccatcagacattgccaacgcacactccaccagtgaacacatgcaccatatctttcccccagagctcacagaacccatctaccagcaactagacctatcgtctctctgtgccctgtcacagtcctgccgcttctaccgagacgacattccagagactctctatgaggaaaagctgcaggaggcgtgtccctggttcgaaccccagttctctcatcgctcctcctggagagagtgtgcggtggagtacactcggcgtatgagacacggggccaagttcgctccaactctggtaaaggggtcccatagcgactaccaggaaccaccaacattggccgtagatgagcaccaatttttccaggaaaagtactattatcaaacctggcgccgaaatcttgaaaccacccgctacaggagcaaatttggaatcgagatcgacctcgctcccatctttgaacaagttggaacctctggtgtctccaaattcttgttcgactcgcgcccacacgtgctcattgctgtctgcctccgtccagaccaggacccggaactagacctggccctggtcattgtcaaatacaaggattccgaccccatcttgtggaagttccacaacgcaccacgctgctcaacctatgtcctgggtccccatgttttcctcaactttacaaccatagctgacgacgacgaaaacgactatcaatttcagtcagaagaatacatgcagaggaacatcttctacttggacagaaaaacgagagagtttgtgtctctcgagcacctccatatcattctaaagagcgaatcagcatgcagagtgatttgcttcgacgggctgttccacgaaatgtaccttggcaactaccgcgtcacccaagccaccctggagaaagataagcgaccagtagtgtgcgaaaccaactcttctgttctcaacccacgtgatcttctaggaagacaccactctttttatcatcttgttgagcgggataatcacaatgtcttgaactacaagtatgctgccatgcaattcaagaaaaaaagatccccattcttggtcgatcttagtactggaaattgtgtcaagggtacgtttgttgattgtgaaacaggagaagaaagccgtttaatgcatctacaaactgtctctgctagtggcccggtcttttacaaattcctgcctcgtctacctggatattgccggaaaggtacttcagatcaccagtcgccgtctcagggacttggatcgcagcgacgggatctggttggtcctaaccctatgtgtcggttgaatgaaagacatgccgagaccctgtaccgagctttgatgactttcgatgatccatacctggaagggcaaatgattgcaacgtcaaaagcgatactggaattggggcaagaattggacatctggctagcaagtcgcaatcccccttacattccacgtacaacaagtagacctctttggcatcgtgcaatgacaccttttcatagttgaatacattacaaaagtgcaattctacagtagtgtacacatgtcataaatatattgtctatcaatccaaactaccaatcctgaacgtcaaacttgctcagttcggccacactgctctggatatccttctgcactcgtcgtcgcatgaagaaaatgggacagtctctggaagtacagagaatgtcctggtgaagcgaaccctgacatcgttgacactcggtccacagctttccaaacttgacctccaactcactcaattgacccaatgcctgctggtacaaagctccggccttgtcaacacagttctcacagacagcacccttggcccatttgcctcgaagaggcgttcgacagcccttgcacatttccgtcttgacggcaaacttcatcagtccaccggttgaaggagcagcaacagtgatggtacgtgtatgtgcgccagtcatgagctgagcagacttacgctcgccgagaatggggtcgaaaatacgctggagaggcttctgcagctggttctcaaggtaatactttgtgtcgatggggatgttgttttccagcacgtacgatgggtcttcagacttctcgtagttcttgcctccgacagcacccttgatgataacgtaggcaactcggtcacccagcgcaggggcagagcctgcgtctcgctttcgcatacgctcagccagctccacatgggcctgcttagcagcgtagtcctgccgagagagctgtttagtgatgaccaactgcgacaaatccaccttgttctgcaacagattggcaaccatggtcttgacgtaagcctgggcaccctccacgtctcgatccatgagaatctttcgcaaaacagtctcaatcacgttctgcaccagacgacagttgtctcgacgaactgtctcgatacctttggtgtccatcttgtcaaacttctcggggttggtccagtacagaccagcatatcgcttcttgttaatcaaaagataggggaaatagaccttttcgaattccagcttgatgggcttgaggaacatctcggacacgtattcggcggcttccagacccatatccatagcagtcttgagatctggcactccaaacttgaccataacagaatcagtatcaccataaatgaccttggcgttctcggggtaaccgttggccttggtgtacttgttctccacctgctccttggtgaactggatcatatctcgaccgtacgcagtgacggaagaagagatggcaagacagggaagcttaccaaccgtggcaccggtaaatccgtagacagaattggctgagatcttcagagccagctgacgaccgtccagcacggccttcttgaaggggtcggtctccttcttcaagtcggccttggccttcttacgggcactcagaagctcttctagaacaatgggaagaataccctttcgggtcttctggttgacaaacaggtctccgttgggggttcggtggtagtcttcgtcaagcttgaggtccagacgctcaacggtagccttatccagtagagtggtgtaacagaggttatgggccatcataatggaagggtatagagacgagaagtcgagagtggcaatggggatatcgtagtatcctcgctcaggctcaataaccgtggctccctcatactgttcttcggaagagccgtcctgtttcaagttgggaatgaccattccgacttccagggcctttcggaacagctgcgaaataaccttgatctgctgacctcgagaaagaaggaaggagaacgggactccagtgacacgagccatctccgtgtagttaataagacacatgagcttgtccatgagtcgctgaggcagataggcatccttcaaacagtagaccgccagacgtcgacgggtgtctgcgtttccattttgcaaatctgtaatgatagagtggtgcacatcttccttctgctcctttagaaagtgagcagacacagcgttcagagtgtacgttcgcagcttgtactctcgctgaataaactgcagaagatccagctgcgttcgtccatcaatgttgagcaccttggactctcgtgttccgtacgccttggaagagaaggtggagtctcgaaggacattttgaatatgcgtcaaccggccaaagtaggggaagtctgtgagtttcaaagtctttgcgcggtcgatgagatagggaaaatcgaagttggttgtgttgtaaccgataatcacgtctggatccacctcgttgacaaactgcttccatcgcatcagcatatctccttcgctctcgtgctccagcacctgggctcctgcaattggggaacacgtgttgagagtgaaaacgtttcgtacaaacggacgagtgtctccctgtcgagacacgacgtttgcaatctggataatggggtcgattttggggtctgggaatacaccctttctgccggcacactcgatatcaaacgagagcactcgcaggggggcaatgtcactccattcgccgtcggcaggatgcgcgatgagatctttgtaggagatgttgatttctcgctgacatcgagacacgagcgactgggtttcaatggtgtatttgcccttgggcagcgtgacccaactcataccactaatgtgacagtcgatcatacatctcaacacgtagggaatgttgtcgaaggaggtgcatccgttggcaaacagcattccgacttgggcgtgtgacgaggggaagttgaggtttccgttctcaaaagcagatcgtagcttagggattagttttgggttggtggcgaagatcttaaagaacttggccttggctcctccgttgtatccccagaaagattctctttcacagacctccaggcgttccagggcgtcgggaacggtgtttgcaatggcagatttgagagtgctgaggttttcggccttgaacccaacggggacaggagcgtaaaagtagtggcaaaagccgcggatgttgcacagaattgtatgtccctcctttgtgactccaaacagacgcaccacggcgtgtccgttcaccgacgcctcttccgcgtcgatctgctggaaggaaatgtcggttgtctgaggatcgaattccttccattcaggccggggccacacctggtcgtccgacacgacagctcccttttcggcgtctgaggcctgggtcagcagaatcagctcctcttcaaagtcggtgggattgggctctttcgtgaccgatttgattttcttggtctccatggcggccacgtcgtcgcccgttcgcttgacgttcatgtccacttccattgacggcattgtgattgtgtgtgtatgctgcggtgtggtggtgaagaagggaagcgcgtgtctgataattagatttacgcgtgccctgtgggtggcggggacaggtctccgtacaacgacgagttttgatggcaggaaaattccaaaagcaggaaaatgacgagaaaactgtcttgtgggagcggggattttccgatccgaaatacatccaatattcgcggtccagaccgctgtctctgtaaattgtaataagagaccgtattaggcaatctgtatagagacgcgtgggggagggtgggaacaagacaatcggtccagttttggcgccattgagaaaaggaaagctggaatatgaagaatgacgtgaatatagaagtttgcacttttcagatttacaatactaccaatattgcggactctagagacgactctctgtgcagaagcttgtggggaggtgcagcacgctgtgtaccgctgattcaggacaccatgctcataacctgtcgtctggggcgtcccaagagcaaggaatagacacaaaaaggatatccaactaatccccataatttgctttgttgttgtttttatttcctgcgcttttcctgtttttttgtcattctacaccacttcatcgcaagactggttagcgttcgaggcgcgttcgttgctcagcaattgtctacataaaaaggaaggcgttgattggctgaaaaaaagtgaattttcgaaatatagacgcctagacgaccgttatacgggatttcaccaaggaaaaacacattcgaaacatgatttacggctcaccgcaccattaccagcggtccaccccaagatggaagcacgcgtttacagttgaaattttttttacgcgctgcatattaattaaaaaaattctgtacctgtaagcgggtgggagtggagtgcccaggtgtgagcaatagatgagaaatagagctgggtttgagttggatttgcagtgtttaaaaacgtctctttttcgagcgggtacatagtatgtagtatatattacagcgattgcagcgtggttggagagaagatggcaaagaaacacgactcaaagggcaactggatggtacgcgaatggtacgtaccggatgcagtttgtacagcagctacggtactcgtgcttgtgcttggactggactttggaccgactcgatgtagctgccgtaacgcgtaccactgttgtgctggtgcttgcaggcggatccgacgacgtccatcttccaaacgcacacatctccgccggaattttcaacaagtttgatactatcgtggagctctcgttcgggcagacattctgggagcagcaaaactccatttggttcaaatttgacggaattatagccattctcgccccaccaacgcatctccagaaatcacactccaccaccaatcgaaaacccaattgagtcacgtgagcatacctattgcgcggtacgtccaagtggtttctccgtttctgatctcgattgttttcagtctaagcagttgcaacggacggtgtcggacagtgtcggaggtcttctcggtgcgataacgataaggaggtcggcttggcgtacggttgtttgcttggcgcacgtgacgtgtgaaattgttgattgttgtctccatctttgtgagtcttgtagatctacagcagagtcgcaggaagaaagtgcggtacggtacagctacaagcaggcacaaccacgggtatattgtacatacactacattcgggcacaagtgcgttcagtatactcgacatgtcgtgcacggcggtgtttcactattgtatcagtgaaatcgtgaaacatctaaaacgacgaatattgacgctgaagacacagaaaaaggctcaaaatgaccgcacaaacgagactgaccgatcaacaacattttcaaccacacttgtcttccgaaactggccgtcaaacagcccgtttacggcccgtatttcactctccaaataagctcctagagtttgtaataacctcacactatttaccctcatcacttagctgcattgagtatatagggcaaaagcaggagtccgatggcatagaagccatcagtggtagcgattgatgagtaatcgaaaacggggagtcaggggtggtttctagagtcacgtgccgacccacgtgaccacccccactaaccacgcccacgtgaccgcccacgtgaccgcccaccaacagtctgaccctgcctctgcctggggttgattgaatttcggagctaagatttcggcttcaactggattgtggcgaaatgctgttgcttgtctcttgtttcaattaggcggtccggtgacattggttgtgtcgttgcacagactgacggttcgggatataaatagggcacgttccgccgccttattttcttttctctctctgtcgcaccggtcgtatccacgttgctgcccaggcacggaatgactccttgactggcctggccgggctgctcttgcgcatcttatcccggatataaaccttgccgatccaaacggcataacctaagtgcttccctgtcgtttatatcgtaccagcacggctgtttgggcggcgggtgagacgaagagggagtggatggcggtgtatttggagctcgagacgatgctggcggcgtggggttccagaaatgccgtctttccagggaattcgcgacatgtttggacagtccgagatttcggatttcggccatctttgagttgcgttcgccagtgtccgaacgggtgcaactcggtgagtatttggggtaaacgggcggcgaaaaccccatcgagtagccccactgatccggtccgtctcagaagtccaactgtccaaatcggcccactgcaacacgaaagaaacggcgcatcttccagtctttatcttttccgacacgttaagcattaggctacaagtaggtgcatatataaaggtgcgtttaaatacaaaagtaaaaagtcggagctgcctttttataagaggtgtcttccgtctaccgagctcaaaacacccccgatacaccaccatggccgcccatttcgatcccccggagtacccctgcaaaaagtcgaccttgccgccccgtcccaagctcaccggcgagcaggagggcaagtacaaacaggtgctccagtttttgcaggagaagacggagtttccaacctcggaaaagggcgcggagaaaaacagcgggcccatggagccgctgacagacgaggaaaaggcgtggctgtcggaggagtgcattttgcggtacctccgggccacaaagtggaacgttgcggacgcgcagaagagactgctatctacgctcggctggagacgtgaatttggagtggagcgaacccgatccaacacaattaccgcagaccgagttgctgtagagaacgagagcggaaaggagttgattttcggctttgacaacgactcgcggccgtgcttggccctcagaaacggccgccagaacaccgaggcgtcgcacagacaggtggaacacatgtttttcatgctggaacgagcaatcgactacatgcctcccggacaggagcagctggctctgctgatcgacttcaaggcccacaccaagctcggcaagaaggtgccctccatgaccaccggacgacaggtgcttcacattctgcagacacactaccccgagcgtctaggcaaggctctgctgaccaacctgccctggatcgcctggacctttatgaagatcatccaccccttcattgatcccaccactcgagagaagctggttttcaccaagcccttccccgactacgtgcccaaggagcagctggagaaggagtacggaggagacgtggactttgagtaccagcatgccaagtactggcccaagatgaatgagattgccgacaagaagcacgccgctttcatggcgcaataccacaagcttggaggaggcatcggactcagtgaggagaagatgcgacagcctctggatgctgacgaccaggccactttggtgggaggaatgaagaagctgtccgtttaaggagccaagcttggacacgaacctctaacacccgatgggagctctgtgcttgaacgagtagaacgcatcttcacttgaaagggagctttatgaagctacaaatggagctttgctgcctttctgacttagagacccatccacaactctggaacatgtatccatgtgccagactagaatgtaattagactaatgataatgactgcttatggtgaatctgtaggttggtaggagtgagagtgtgacggcagtacaatatggtatcagtatgtaaaaagtacgagtatggtataagaaagtacggtgcaaatacgtacgagaacggtgtaaataggcacaaaaacgatataaatacgtacaagcacccgtacttttagacattgatactaccgaggcttagatacttgctctctgccctaatccgccattttaatatgctcagcgttacaacggttgagtctgaaccagagttctctacaaccactgtatataccaccagctgggtgtttcacggagaaaggctgtcgacaaatctactagaaactgcttctcttttctcaaacccctctccgttttctcctatccatatctacaggcaggttcttccagatcactcactcactcattgattattcatccgcatcactcgggccttattactcacccgttatgcaaatcaactttatcggactatcggcagcaatagacaaagacccgaacaaggacaaccagtgcattagtggcacccgcgttacatgagcggtttttcggacatctgaaacgatgcagatttcactggccaaaatgggtcacgtgaccaacgtagcgaaaaacaaaatttaaatcatcacaatcgaaaaaaaaattaacgtcgcgccgggtcgtgtgacatctcggtagtctgtggaactttaactaaaatactgatactatggtgtagattactaagcggcggtaagtcacgggacctgggttggcatcgccagtagggcgcagttccataacctccagacctcttcatcgccgatactatcttgtggttgacgttggcgtcctcctaaatcctagccaccttctcctcgacctttctatatcggcttttcagatatttgagaactgtcgagtcgttttctactgttttctcacatatggtgtctttctatgtcactttcgagaggataaatcggtaccaaaatgaatctccgagtctggatattctatcagtactatcgggggctctttattgttgtttcttggtcgcctggaagtattttgatttgattctacaagtatcgtacttggtctacaaacaagccaaaccacattggactgctatccgggttgtcagagagtatgaccatcgtatttgcggtttcgtatccggcctttataccggataaatgtgctgtaaagtggaagtctgttgaacggtcagcatcgagtggtaataggtcgtgacgttcgtgggttgtggcatgccagagatgtcaatgtcgagcggtgagaagggctaagagacgaattgaactcggactggaatagtcgagttccagttaacccattgactggttttatgaatggagttcactaccgtcgagcatctaaacagatatacaagtactgtacgggctagacagcatccctaatgtcttagacacgataaactagctgataactcacttactaataaacaaaacaggtacttctactatacctactgtactacagatttaccaaccacttcaccaatcgttagcactgtcatcatggctaaactcgttacctcgtaacgaccaaataatcgaaacattcacttgtacggtaatcaacaatcaccgtctcaaacaggggtacagtacctggtaccttggaaatagtcgtacaatatagagattattgaattatattgcacaaacgaatttgtggtttataaaagtatttgttccaatatctatactatgtaaaaaggcaagatattacctaatctaatttcgattgttgatattgaaaagtatatatatatatatacccatgccactaaacgtttaattagtaatattcgtgttaacatacattaatttcaaagattgttctttcaaagcaaagtcataatcaaatgaacgtatatgcagaaaatatatatatatatatatatatatatattcagtatatatttttgatgttgcatttctaacaacacatatacatcaaataatgtatttttattgaatgagtagcaatttacttaaagtaacagcggattgacaggagtacactcatgcgagacgcaatcagagcttctttcgagctcaacaagcccctcaccgcggaacatgccaaccctcgagaagatcacgagccctctacaacagacacagttaatcacagaatttgggaacgaaaccaggtgaacgtgagagcagcagaatctttccgggaagcgcacgtcgacatcgcagccgcgagacgataccatccggtcagaatggtgtccacagcggaaatcgaccacctccggtggagcatgggaccacttactctaaagaacttcatgtttcacaagacctcgtctcccgacttgccaaacttcccacacacacttgcacgaccgaagaagtggactcaacgaagcgactacgggggcatcgctgacgacatggtctggcaggaggtaatgcatgaccttcgaaaacactacatcgccgacgccaacaaagcacaagttcttcacctcatgcggatatctcgacttccgctcgtgaaatggagataccctgacgaccacgttttcaccaagaagaatccaggatgcgggctctgtgataaggccatcattcaggatctgcacgagcatatcttctgcaagtgcgaagttcttctttccatgttgaccaggatgaagattccgtcagtggactctctaaaggactggatctttaccgagtcgaaatgtggagtactcccctctttcccagggcatgtgaacagtgacgccccccggaaacatcaacaagtcaagacacgcaaatatctgcgggaattggcttatgggatctggaagatggagagatccctccggtactcaggggacgacgccaccctgggacatgtccaacagggtttgcttcaattcctgaaggaagcccagatgtgtttctacgatggacaaccgccagcacttcacgatgagcgagagtagcgacagtagcaagcgtaaaaggcggccgaggccaccgagagaacagcgtagcagggcgcgtagtcaccacaggggacgcagaaccaaaccaatgacgaagaagaaccacaaggagacgttttcaaaggcaatgcaaacgaagagggcaatggaaggattgagattagagaactggagactggagtggcgttttcccgatgaacgaacaaacacgcgaagctatgtggaccaacatacaacacggactgaaccaggtttttttatgatttttttactggaaataggtacgtgccaagttggaccatgacactaaacgtgtttaattagtaatattcgtgtaagcgtacattcatttcaaaggttattctttcacagcaaagttataattaaatgaatgtttatgcagaaaaaaaaaaaaaaaaacagggcagaaaaagcgtaatatgacttcaaagaggctttgccgagcgccaagcgcatgctgccaagctcgcaaatgaaaccgcacctgcaaaaacaggtccccgaggaggagagattactaacaaggacagacctggctgtaacgggctcaggcaggaaggaaatcacacagtaaggcaaagtgtcaagatcgtgggctgcgtatcgtcctctgtcacctccttgcaacttttctccttcacagaaatgttcaacaagaagaagtcaaactgccaaaccccgttccgttggtgctaaacccgctgggacggacgttatctccgttgtaatcggaccctgttagtaattgacaaggttttacgcgacacgaattagcttacagtgccaaaaagagtagaaaataaatatatgcaatggtgacgccaaaaaagatcatcaagatgacaaatggagtcgaatcgaacgagcatcttccttcttcctccttccactcccttccatcttccacacggtgcaattttcatgctcttgtgcatgtactgtatttgtaagccatccacggaacttttatagcaaactaatttaagccaaagtggacctgcacgtgtgctgcacaacttccaagtgaaaaaaaaaaaaaaaaaagggggggaaaaaatgagcaaaaaaaaacaaagcagaaaaaaatgacaaccgagagattcgaactctcgcctccgaagagaccaggatacttcgttaaggaattagccttaacctggcgccttagaccgctcggccaggttgccctaactgtttggtcaaactttgtttgaaccgttaaccgccccctactgggtcacgggtcttagctgactaagcaacgacaagaccaatggcgcgtatatttttgtttctcgagtatttgtcaatttcagctattgtctcttgctgaaatgtctcgtttgggtctcgaaatctacgccaaagtcagttttcgacacgacatgcatagtcccacgtacctgtagctactgtagctcttcaccaccctccacccacacacctcacacgatagcacttcgacgatgggtttgtttgaaaaactaacgcaagtggcgaaccggctgggtctacgggacaagatcaattggctggttgccattgctgtcgctgcttgtcagcgtgattggagcgctctggctggcagttctgcctctagacggccaatatcgatacacctatgtgagtgaaaatgcgctgcttccgggccaggcacacacgcattttcgcgagagtgagtggaaccacgtccgggcctacaagcaggagattcaggcgattgtcaattcggaggctggcggtcatatcaatgagcaggagcgaatttcgcatgtacgagggtacctggccgacatcgggctcaagacgtcgctgcacgagtggtccgtcgaccatttctccgagtcgtacaacggcaccaacgtctacggcgtcatgcatgctcctcgaggagacaatgccgaggccatggttctggtggccccctggatcaaccaggatggagagcacaatgttggtggtatcagcgtcttgattgcgctggccaggtatctcaagcgatggagcgtgtggagcaaaaacattgtgtttgtgatccccagcgactccggttttgctctacgttcctgggtcactgcttaccataccagcctggcgcttacggccggagccatcgaaggcgccattgtcctggactaccccgaggcgtccagtgagcactttgattttatggaggtcttctatgagggtctcaacggccagctgcccaatctggatctcatcaacactgctgttattgctgccagcactgagaatctggctactgtgatccaaggagtgacggaggacgatgagagctttgtcaaaaagtacatgcctgaatccctcaaggagttttttggcaaccagcagatggatgtgctcaacagatacgccaaccgactcaagatcatgctgtctggaatgacccgtcagctgacaaccggaatcagcaacagtcctggatcggaggcattttccggctggagaatcgacgccatcactctgcgagctcgaggaactaccggtccctttgatatcactacctttggccgaatggcagaaagcactctgagatccatcaacaacctgctggaacacttccaccagtcgtttttcttctacctgctgctctcgcccaccaagtttgtatctatcggcacctaccttccaggagcagtgcttgtgtgcgcttctttccccctcactgccatctacctgtacgccaccaagcccaatcgatcgacttcgctagtgaaatctttcttcatcatcattgctgtctttggagcctgcaccacgattggaggggttttgactgtcgttcctacctctgcagtcggccctgtactgacctctctcttcgtcatcagtgcctgtctgcctattttgtcggtggtggctccctcacctcctcctcaccctgccagcgcgcccgccgagcccaacgttaccctggccatctccttgttgctccacggcctcgttaccactgctctggcaaccatcaacttttcgttggccatggttctgggtctgctgaccgtggcattcaacttcatccgtcctgggtctgctcacaccaagagcaacctactgattctcatcatcacatgcccttggacttggctggttgccgttggcgccgttttgcacacctcgcccttcgatatcctgcagatgctcctgtggtcgcttagaggtaaccaggtgtggacctggcaggtgctgttcggtctgtggctgccccagtgggtgcttgcggttattgtctcgcgctcttctacccccgcccctgcccagtctactgttggctatttcagaaagcagtaattaatgggggggtgcttgtgcttgtgatgaaagaagaaagaaatcatgtctcagaccactgaccaggtgttacacctgatgaatgtatacccttgtaggtatttaatgtccgtaatatatttatgatgaatagaatattggcttgtgtttcaactgctcgttagctgtctctacagttctcacttgtcatggtagatgttgttgaaggtacccaccatgaccccaaactacactggagtcacattgttgctgctacatatattgttttcatcacgcatggagtttcgggggataccttctcgtggaggggttgcaactgagagagctgagaggatgtcttggttgaggatgccaatagggatctttgtcggagttgacaccaaacttgttcacctgtctcaggttggtcacgtcgaattcattggtgtcttttggaagacgctgttgggggtgaggtttttctttcgggctttgcactctcacaaacgctttggctttgggggcgtacctgaacagtcttaagttctctcttctgactctcttgaagataggaatggtgactgtgggttttctagcgccgctttcgtgtttgtactcttgaatgagatctctgagcgatctttctacctcctcgcagggctggatgatctccttgtccagtcggtagatgcattctttgaggatacgcactttgctgagcttgtgctcgcgagcagtgtggtagtcgaacgtcggtaggttgccgagatatgccgtgtacaaggccagaatgagcactgttgctgccagctcgtagacagatatcatcttgagcggtgataggggctgtttatgagtgatctgtttacactgacaagagaccggtctggtggattgagtgcggataggtcggatggggtaggtcggagaggtgtgggtcgggagtacttgtggatgtgtcaagataccgctcggtgtattcagcagtaggacagttggtatactcaatggtggtgttttaaaaaatacagtaactgtacaggtacacatgttgacacttttcacaatattatttcgtttgtcagatcgctgctgtagaaacaattgtgtatgtactgtatgtatgaatggttttctttgatcaaaatcaataagccgtttaatatcttgtctgatcaaaaggtgtacattattggtctgtttcctgttattacatttcatattttgctgaaattaattgcaattaatctacgaaattatctttaaatgctgcttaaatatccccaaagattaataaactcggatccattaacatgcatgaacgcgtaaaacttgctccatggcgacacacaccatgaatagcgacattcccgatcccagcgactggatcgactccaagctgagcggcctcaaagacgtggacgagactctgcgctgccacatctgcaaggagttcttcactgcgcccatgatcacgggatgtggccataccttctgctcgctgtgtatccagcgatatctcaccaacaccagccagagatgccccacgtgtatgcaggagcagcagatttcgcagctgcgcaaaaacgtgactgtcgagaccctcgtggagcatttcagcgcccagagagccacgattcttcgcgtggtgaaggaggcggcaaaacagccgattccagaggtggtggagccacccagcagtccagatttggacgacggaagacgccggtccggtcgcaaacgtacgcgcacaaactacacagaaaccctggtctcgtcggacgacattcaggtcgagtgtcctgtttgccaggccatgcttccaggagcagccatcaacagacacctggacaacaactgcaacgacaccggagccaatggaggcaactggctgggcaccaagaaaaagaccaagccgctgcgcaagattcagcgagtcaaccaggcgtcagaaagcgtggccaacgtgcgtcgcaaactgcaggatgaaggcctttctacttcggggtccaaacagacgctgtttcggcgctacgacgagtgggtgacgctgtggaacgcaaatgtggacaataagacgccacggtcaaagagcgatatcaaggacgatctgcgaaggtgggaaacgacagtggtggcaaacgaaaacgcacaaccggtgaaaatgaccatcaagaacattgacgatagacagtgggtccagaaacacaaggaagactacgactatctgatcgaacaggcaaggaagtcgattctcaagaagaaacaggaaaaggaaaaggagcagcagcagcagcaggaggggcaccaaaaagcagtggatcgcagggaggacaacgagccggacatgaagaggagtgaaacagaggggtatcaggttgtctcctaagacatagaatgcatgcatgttaacacttacaatagacataaaaagatttatttgaatcacagaagcgcgtttcgccgcaagatcgcccaagtttgaagtcgacagtcatcgtggcacagagctcccacaggcgtgaaagtacgacgttttgattcgtctcgttccgctcttcaatttgatctaacaatatccacacaaaaaaaacacaactcctcccaaaactgggtttcgtatcgaagtgaggaccttcaccagtcagaaagacgtctcgaatacctgtcttgaacagagaccagaagaagaaacaaaaaagaaagagccaaagagctcttatggacgacaccggaatcgaaccggggacctcgcgcatgctaagcgcatgtgataaccaactacaccagacgcccacgattggagatgcgggttggatacgtgcgttttgaaagacaaagtgcggataattcgtcgtaatgaatcattagaataaaaaaaaaaagtcgtgttatttaatctaattatcgaccctttttgtaaatatttattcaagcagctacttgtacaaaacaagtatttttgtcaatgtttttttgtatacagtgtacccaagacgtgtctttacttgtatatatactgtaattatatataattatatatacccactctattctacattcacacaaaactgtttaccgctcaaaacaatattcagtgtctgaaacactcgccgccattgaaccaacacaatgagagatatccaggccagatttgcaaactaccactcagataccccagccagatacaccgacagatatccttcaacacatccagtgtttcaaggcacagcaaagcgagccaccagaaccatgtctggcttcgctaaacacacgtcaatgagaaaagcgattgcccaaaaccagctcaagatgcatgttcagacccaggactttggaattgctgtaatccggaacgtgcgagttcatcagacccaggacactgtcatgtccaagacccgcgactttctcgtctggttcgacgaagtgtgggagggagcagacaagtggaggttcgatgataactggaaggagtttgacgactcttggggccagtacacggagcaccgtcttctccttcgtgtgaggtgaggactggggcatgtcataacatgatccctttagctacatttgactacagctttgatattaacgggcaggtgatacataactaatgaacaaaatagaaagaaactgttttcagagctgtacaagtgcttattgaactggagcagtagtaatcgtaatagtctgggctggtcaatcacataaatacaattcttacttatactagatctgcaacactaccactgacgggttccaacaatcttctggtaagcaatggccacaaacaggatgagaatggtcagaatgataatgtcaaacagcttgttgcctccaaagttgccatcggcagggatatcaatgactccgagagtgttggaagcagacacagagacagccatggtctcatcctcgttaagagcaactcgggtgatggcaaactcatgggcctctttgtactgtttgagcagacgcaggttgtcggcggagaaaatggatagactgaggtcctggtgggcagtgaagatgtacttgtcgtggcaggccagagcagtcaccttcttgaggttcttgtacgagctgaatgacacctcttcgaacttgtctccgtgcatcttgaccagcttgataccatccttggctcccacagcaatagcagcaaccaccgccgaggacttgaggaaggcagcccgggagaaggtctcgcccttgatagactccgagttgaaaatgtgctttccgtcggccgagttggctacaacaagagtcttgtccgtcacgtagacaaacttggactcgtccagagacagagacatgccgttgatctcactctcggtcttctcctggaagttgactgcgtgatccttgacatcaatggagtagatgtatccaggagccgtggagttgctgagaatcacagacttgtgcttgggcacagccagcgcccccttctggtagtcgagaatgccaacgtcttcaaagacttgtgaggacttggtttcgctccatttctccttgtcgtccgagagcgagaagagtcgcagatgctggttcttgccgctcttgagagtttcactgttgctgtttacaccggcgtaaatggtgttcttgtcgaaaattgctaagctcgtgggattgtcttcttttttcgacagctcaatctcggagatcttcttgggcatgtcgggtcccttgatcttgacgatgctctgagttagtgtgctccacgtaaccagtgaccaatcacatgaatcacatgaattggttacggcacagaatgccacattgagcaaagtttgtccactttgtttgtgtctgtttccaacccgccagaagcatgcctgccaccacggttcaaccactgatactcaccagcttgttggggatgccgtggtttccctctccgccgcctccgccgacgatcacgtgatccttgtcgagaaattcggccacaaatagtggatagtcgagctccaatcctctcagtgacattgtgtgtatgggtggtttgctgctggtgatgttcggagctacgagtacgtgttgcgcgcgttgattaatttagctcatgcatgaagttctttaatggagagagaggtagaagtcggaataaaatagaaataaattcagatttattcgcattaattcgggtgattgttgaaatatatataacccgccaaatcccgtccctgtaaaattctcaccttctgaatgagccaatgttgagtcctttcatcgaaacacccaattatgtcgtttgcataagcgaggcgttggatgtgaaataattgtaagatcgcacagaataattagtttgctgaagttgatgtccatctggtcaactggggcattttttcatagctcatcattaacagtttcttttatctgcgagctcatgtagtttttgtttcgtgcaaactgtagaaactaccgcgagagaagcacattgcatcatccattgtgggattacttgacaaatgtataatttgttgaacattttgtttacttcttaaacattcacttagagagtttatctccacttccactaaaccaacccctactacttacctcatcttctcccaggcagacaaagttcggcatgaaggagagtgtatctctcccgataagcgcctacttgtagactgatctccccatcccacttttacacaacacagacaccaatgaaacacctgcttgcgatccagtcccacgtagtccatggctacgtgggcaacaaggcagctaccttccctctccagtgcttgggctgggaggtggatgctctcaacacggtgcatttttcaaacaacacgggatacggcacggtcaagggcaccaaggcgtctgctcaggagattctcgacgtctacgaaggcctcaaacttgcagggctgtcgtatgagtttctgctgaccggctacgttcctggagaggaaggagtggaggcagtgggaaaggtgggagaagatctcaaaaccaacaacccttcgttgatctggctgctggatccggttctgggcgacgccggacgaatgtacgtgtcggaaaagaccattcctgtgtatcaggatattctgaagagtggcaaggtgacgttggtgacccccaaccagtttgaagcagaactgctcacaggaatcaagatcacagaccgagaaacgctcaagcaggcgctgacagccttccatactacctataagacaccttacgtggccatttcgtctctgtccttttccgataacgacaatatcctctactcggcaggatctacgctggacaaagatggatcgacctcaacatacatttacgagttcaacaagatcaactcatacttcaccggcactggcgatatctttgcagctctgctttccgacagattctacacctatcacactctcaagccagttcctgacccactgtctgtggctgtgggagaagtgctgggagtggttcagcagattctcaagataaccgatgaaagcgctcgaaagtcgggtataaagagaggcgagattggcaacgccgagagcatgaagcagtgtgagctgcgaatcatcgagtgcaaggatattttcggtgatgccaccgtcccttacaaggcccagaccatttaaccccatatagatgctacaatagatgtattattagtagtcccgacgagtgtatcgacacgaaagggtacagacaagctgacgagagtgatctctgttgacttttatattgcttcgccaactttgaggacacccattcactggaaactccaccatctctattgattgtcacgagccagatacacgcaggtacaactgacgacagtctgactacggtccttggatctgcacgctagccatttcaaaccattgtttgcagcagaaaccccgtcggcttctctgattacactaccccctttggtcttacctatagggcgcctctccacagcacgcaaaagagagtctttggacgctggttcgcgcagttttatccccaatttcaccctttctttttcttcttttggccctacaagaaaatcaagtgaggaatgagactccaaacttcatctgtagcccttttttggctggctcttcggccttttggtacactaccaaatcgacatgatcagagttgatgtccccttggaggaagaagagaggagctaagaaccttgcgatggcctttgaatgagagtctcgagttgattgatagcttgggcaggatgtgattcagaagtgtgtcagaagtgagtcagaagtgagtccggggaggtgattgagaatgaaaggggttagaacaagcaacaaaaagagtggaaaagaaggaaatatcaagagattcctatgtaaacatctgcagctaccaatttataactggtccctatgtgcaaccgcctcatggcccctgccgatgctacttgtactggtacgctgctcggtttctgcagcagcagagagggagctcgagatgactctgtccattgtctccggcacttgtagccatgacctgccattacaaaaggaggtctgagcctgcttcttttggtttaggactcactgactgaagagtatttcatattctgtcgttccaactagggttgccattaaccaatggtcaatctctagtcggccctcctagccacgcaattctccgattacgatcttggactctccactctcatggaagacggctcccgagggagatggaatcgttgctctggacggccaatggtgggcccactcgagagctctaccgcgacctcgttttttaaaggaaagagtcagctgtcttggctcgaaagaaaactgatagcaatcttcaagcgaagttgatattcagcgagaaacacattctccaatctcgctgccaccactccaacaaatggaggccatccctggaacatgagaagaaaggactgatgttgaataaaccaacttttgctatacaccagactcttctctctaacagagagactcgtcaggagagtctcagcactctggtgaaggattcgactgagcacgccatcaggtagacaaaacagctgagagaatttgttcttggaatggaaactggagatgaaactgaaggtttgtcactcacgtcagggggcatctgaaagcaggagaacctgaaaacttgatctgggctcggtgaagatagccgacgccctaggtggcgaaggtcgggggaggtttgatgacatgtttggtctttctgagcattcaagtgtcgaatatcggtcgcgaatggcagaagcctgtgaggtcgtcggtttatctgctgccctctttggaactttgctgttgtttcattaatgatgacacttcttgacagagcaagttggagcggagtcttcaactcgataggagctacacaaccaggacccaattgtccaagttgtagtggtccaggataccctctccagagtatgagacgcgccagagtcgcggaaacaccccattgtcttcctactctcaaatccacaaacgtccacagccctgtatccatgtaattgtacgagtaagacgcaagttaatgtatgcgttagcgtcatcatcgagagactgaagagcagtacaagacacagggtcacgatctcaggtccaaaaaagaacagcttcgcagctgatagggcccaaccgggaattgaacccgggacctctcgcaaattgcctaggacaccctaagcgagaattataccactaaaccatcgggccctggatgaaatttccgagttccgatggagtgggggatcctaaaagtgtaatttttaaaaaaaatgaagaaaaaattcggttttgggaggaaattgggggttattttgggctaaaaagaaagataatcacttaaaaatcatcttcaattgttattatccgccatttcctcacccttgacactcatatcttgctgtttctatgactcttttgtccacctcgggtagtccttctgtatacagtttcgcttatcggataacaaaagtttatattttacttctccgcacaagtgactaattcctggatcatatataattcattctccccgcacaccacaacaacaccaaaaaaaaaacaaaaaaaaacactgttacacaaacagcaatgtcagtgtttcaaacagacgtgcacgctactcttccccggacaattggcggaaagggcacggaattgaccatcgaagaagatggacagactcgaacggtgctggacgcgtgtggaggagcagcggtggcagccctgggacacggaaatgagcgcatgattgccaagatccagcaggctgccggtctgccttacattctgagtcacgggctgggctcgaagcacgcagatgatctggcaaagtacctggtagagcagtctcctgagggctccttttccagtgctgtcttcctcaactctggcagtgaggccaatgaagcagctctgaagctttccaagcagtactttgtggagaagaacgaacccaaacgagtcaattacatctcgcgacacttctcctaccatggcagcactttaggcgttctttctctgggcggatttcagtcacgtcgaaagccctacgctgacgttctcaacacctcaaacttccacaaagtttccacctgtttctactatcggggagccaagcccggtcagacggaagaggaatatacccagcagctgctagacgagctggatgccaagttccaacacctgggtcccgaaaccgtcatcagtttcacttgtgagaccgtcattggagcaactctcggttgtgtgcctcctacgaagggctacattaagggctgtcgagacatttgccacaagtatggtgcgctgttcgtgctggacgaggtcatgagcggaatgggacgctgtggaacgtaccatgcttggcagcacgaaatggacgagggcccagatctgcaacccgtagccaaggtacttggaggaggatatgtgcctctggctgccgttctcatctctccaaaggtgtacaatgtgttcaaaagcggaagtggtcacgtggttggacatcagacgtaccaggaccatatctttgccacaagtgtaggtctggagcttcagaagatcatcaaggaggaccaactggtggaaagaagccgtttccttggtctcaagcttgaaaagatgctcaagaaagcacttgccaacaaccccaacgttggtgatattcgtggacgaggtctcttctgggacgtggagtttgttcaggataaagagacaaagaaggcgttccctagagcagtggggttttccaccaaggtttacaaggccggcatgaagcgaggagttcattttctgaagggtgtgggcactgtggattcgttcgaaggggaccatatcattctcagtccaccttatactgtctccgaagaggagttgaccaagatagtggatgtgttgaaggctagtgttgaggaggctcagggtgagtccttgtaacaatccagttatattcatcttttgctctgtggtctatcactgtatgttctatgcatataatacaatgtttaatatcgtgtactcttacttgcaccaggcggggatataaaatactaccatagttttcttttctcagttttccgcccacaattctccgcctaaacagtttcctgctattcgcaagtggtctggtatgatttccttcttctatatatctgactagtgtttcatgctaaccatccatctcatcaggacagccatattccctttccaaggtggatttactttctgtctctttcgagacgccaatgttgaccactgggttggtttgcacaagccaggtttacttttgtttctcatgaggcggagtgtccgcttcaggactgttccttcggttgttggaaaacatgcaacgaactgttttttccaccattaaatcggtgctaatggctctaactgatggaaaggtacgaaatttactctgaaaacaaaaattccacataaaactgaacgggggactgaacctgagagggctacactacaagtaggcgtcaccgggttcctacagggagtgagagcttgaaggcacgaggacgcggagggttgtaatgagagtcattgatgcaactgatgtaggaatgagaagggggtggagaaacaatggtttaaaggcccggtatatctcactcatttccaaagaagagacagtcaagtgctcgtatgactcctcaaacattagcttgtagtttggcgataaggttgctggaggtgcattatctgaactctaatgggctcggtgagatgaagaacaagaaccgtcaacaacatcagttactactgtatctagtacagtaaatgattagtggtttggaattggttgaatgacaatgtcatatttctttggaaatgggttgaatgataatgtcatactttgttgatggatgatgttcttagctggggtaacaatgatcaggcccccggtcaaaagaactctcaacctcctgcttggttatagactgctaaagtacatactgcagttgcaacttttcaacacttgtgctgccatcgatacaacaaatttcattactttccctcctcctgctcgttctcatctcactagtcgattgtctgctgtatgtactgtacttcacgtacctggtcaacccgatcaagagtcaatgtgcaataccatcattggtcgttactttctgaatatggttgtaacgtgaaggatcagtccaactgcatatatctcaccaacccaactactagcagcagatctccaaccgcagcttattaatcaaaaatatcagaggaacaaaaaatacaccgatcagctgaagctatgggacttaaacccacaatgtttcctccactgtcagttcagagaacttgacatggacaggaattgaacctgcaacccttcgattacaaccgagaagactggagtcgaaagctctaccattgagccaccacatcagtgcgtcggatccggcttgggtaggagccacttgtctgggaaaagaaagaaaagtgctatgatgacaagttcatatggtctatccaccatcagcaccccaggattatgcgcaaaacagctaccgtccacatggccaacagtctactgatcacatattcctacacgaacaagagtcacgttttttacctgttgcaacgagcccacgtcttacagaaacattgtcgcaatgaccacgtttatcacatgccattcgactttacgtcatctctaataccgtctactgcttcttcgtttctcagcagtccaagatgtcagtgtctgatacgactacggtatgtacagtatgtactataccttttaaatattgatccggtcaagagatggaacaggaagaatccgtgaacaagcgaaaaagaatgcaatgcgctcttctgaacgatacaatccgaatccgatttgcgggtataacattgtttttaggcccaagtagctgaaatgtattcagaattaaaagaagaaaaaaagaaacaaacaaaaagcaatggacagttattcacattataaagagacttgtatattagtctagtcgttatctaatcgttatctaatcgttatccagttgtcatataggtttttactcgtttcaactttttacaactgctgtaagacttgtaagcggagtaaagagacatggggctatgagtgatgaaagagatactgaaaagtaagcattctatcactcttgagagctgataaaatcctttggagcgtatataattcaactttgatggaccgccgtcaattcaaatcacttcagatctgggccactggagtgatggtatgtactgtagtcaaagaaaaatcatcttacaccctcaattatttactcatacttggagtgtttgaacttttattcacgttttttacgtaaatacaaccaacgtctttcagtccagaagtatctgatattgggaaccccaaaagatgtgcaagtatctattttgtgcgcggaaaacaccaaaaacaaccttggaatccgaataatacattgccaaccaacaagtactacaaccacactgttcatgactgtgctccgccagccaccgttaactttctttcaatcatattcactattaataaatagagtcgatcaacgacatggcgactagaaacgggcccaagatgcagctggggccgtctccgatgcaacctatcctgatagattgcagtttaactaggacagttgtgtttgtcctaatgaacgaaaaaactatcaaacaatcctcccaccgtgcccatcttggttagtatctatccaagaccgtaatccaatgaaggagccgtagcacggtggtaatctgcacaaactgtagtgagtctgtgcagagaaagacaccagtttcacacaggtgattcatcgtgaaccccaaggtctccactgtacgtccatcagcatgccctccgttgaatatgcatgctgctcagtgaagtaagagctgtgggtattctgggcgtcactgggtgtcagtatgagtttagaacaacctcgcttccacacaagtatgatcaagggccagtccaggttgaaattggaactgaccctggtgttttgagaggatctaaatgggtttatatattgagcagaagcggtcggtggcgagattcacgtgggtggcaaactggacatgtggcaatgagacaggcactcagaatattggcatagctatgggaagaccatggtgaaagatagagccgggaatatggacatatccgacaccccctcattaccaattacagcaacttcatcatattataaaataaaaagtgcagtagttcttgtacagtacatacagtactgtactgtactgtacttgtagtatataccattcatgtccgtcaatgatatctccagagttagatctcatcgagctgatgaaactgtactttcgccactgtgggaagccctcgccaacacttcctcctgaagtaatgatagacgagtataaccgacatcgtgtcggttatactcgtcacatgtatctataacccctcaatcttttcacaaggcgaaatggaagattcagaaatctgtagaacaaactttgttcgccacagtagactgcagctgaactgtaagatagggcgtggttgaaaattggaggcagagtagattctcgaaggaaggggaaataatgtctagcttcacgcgacttttgagggtgtattgtatgttatttagctccatagaggcccctacctgtctatactgttcacctcaccttgctgattttcgccacattataagctgcttcaattttaacaagcgaataatttttttgagttggacaaacaaacagaacgttagcgaatacgatgcacacgcgagtcatacctccatttcacacgaagatttctccagaagataaccagcttactgggcgagggtgtcttagttctgagagcacagagtgggtcgccggagtgtgtccccagagtaggtcaccagagtgagtccccagagtaggtcaccagagtgagtcaccagagcgagtcgccagagtgggtcgtcagagtgattctctgtgattctctgtgattctctgtgattttctgtgattttctgacattttgatcgactgacccggtaaagtgtctgttaaaggtaatgttcaaggaatactggttgcgtcctgtgcgctcgttgctacattacgtacagtgttgaatgcaatgacaccaagctccatacattccattacacagttgttatgatgttctaattcgaccaaacatgaacagctccgggaatatccccactcaactccacaatgtcagattcttgggtgtacttggccttggcaatggtaacctgtcgcttggtggaatcaaaaatcaccagggctctggaaatcaaaggagggcccgtcagtagcgtcttctggtcatcgggagcgatggtgatgtccggaaatcgacattttccctggtcgtccttcctaataaagatggaaaagtccacaggaacaaaagtcgtgccaaacacgtactcaagagtgggcttggctccgcagtcaacataccatccgttggagtcgtaacctccattgtgctgattgctgatttgacccacagttgagttagagagctctagggtgatacctcctgtgtccagaatgacactatgtttgacatcctgctgggcgtcttttccatcgactttgaatccagagatgggcacctggtagaattcgtagtccacatcttcaatgtcaaccgtcgtcagaggaccctcgtactttttggagtcgaatccgccgtagtacacgttagaaatgacgtgatcccacgaagaagatgtctcatgagttccaattggttcttcagagttaagtgagaaaatcgaccgagggatcttacctgccgcggccagactctctgcgtagctcgcttgtgcatcatctcctttcaatggaccctgcccaaacactcccaggttgttatcaatggtatcaagagacacccacacctgcatatcaacgtcaagacccgcatacttgacagtgtcgtttccagtgattccatttccatcccagccaggagcgtatccgttgaacttccaggtcttggaggccgaaatgtcaaatgaaacaccttgctgacattggccctgaagacaagccgtggagttcgtaccagggacccacaagtgtcccgatccagtgtcgaaaatcacacttttgacttgctgggaaggagtgcccacttcaatgtcggccaaatagtagagctgacccatagagatgtcaccgtgggccggtccgcccttcaaaggcaccttgatgactccagcagcagccacggaagcaaggaggaggtttgagaagatcatgaagattcgatttggtacatttgacaaaagaaaaaccccccacttttatatatttcaacaagattcacggcgcaaagttagatctgaagtggagtttctttgatccggtttagtggaggggataatgaaggtctgaagctgagatttagcatcgattacaacggccattataactcataattcccgttgctttcactagaatccacccataattgatgttgtggacagagaccttgcccaccttatcaatgtaacattagttgatcgacagaacctaatgagtgtgccgtttgacaagaggtggcagagatcctggttgcgaaatgtcccgtgaatctttcaagatggctgtgaagtgccacaaccagagttttgcgtaaaattgaaggcttttggtcccccatttctacatgtggctttctcatagtagtggcaccaactgtatattttgagattgagaggggtcaggggtttaataaagctcacattggaactttgacgtctcaactatgtgctcaaatcgtcagatttccgaatacactgtctcaaacagtcgaaatcgccgccaggaattttcgacatatttcagaggtaagtggaaaacttttctcagaattttgtagtggtcccggtggccgagtggttaaggcgttgccctgctaatttgttagctgtcaggcagtgggttatgcccgcgcaggttcgaatcctgtccgtgacgatatttttgactccagttttgagaggcaataattgctttgattagatccaccagtgtcgcttttttttgcttttctttttttattattattacttttctcgggtagaatgttggttttgtttcacttggctgtttgggtgttttttccttagcttccttatgggtagatggaaccatcgccaagatggtcaccaccaacgcccacagactgtgggtcgtgcagcccgatgtgccctctccacagccgtcgaccccctctggtcagccggcctccaagacccacggtccctctcaccacgctgctcacaacggtaagctgattggagtggtgtcgctgaccgacattctcaatatagccaatagctctgtcgagatgatacatccattaaatactgtagaacagactattctcacactgttaaggtactcttagtaagcaagatttcaggtgattggatggtcatgtgactcccaaagactcacctgaggattctcattcttcaagtgaggggatcatcatattaaggttattcaacaaaatttcgttaaagtgttgaggtaatgttaagtatttgaacaataacgttgaaactcccaattaattcttcacaaacgacatgacacacaaactgagaagaatgttccacaggttgaaacaattatatatagagttagttgaatgttagtagatatgcggcccatatatggttcttcccaataaatctgttgagtaaatataaactatagacaatttgttgagtaactttaaattgagtgccataaacttgtcgtgccataaacttgtcagataatcaggccacttttaccagaaaatcaggccattttctcgaagcttatttcaccgggcataaaacaacaccagagatgtatttctggtgttagcgttgataatgcagggactaatgagatgaaaactttagtatgcactacttcgaacccaaaaattgaacatcgtcaaaattggagttgaatggagtcgaattcgcgattttatataatctttcttgatacgaaccccgcacgtaaaaatcaggccataatttaaggtcacatattggttatagcttaattgtctgtttgtgtaatataaatatacccccagtttctagattcaccagaatcctctattcatgttaaccatcatcgccaagaatccgccaagtacgtgtttcgtctcgaacactgaaatagacggcttctttttgtcgccggctaagaaagaggcggcttgagtgagtatttatgctttcttctgttcgactggcaccactggggactttttggcaccattgagacaaaaatcggatgtttgtgacacaaacagctcgacacacgacaccacacaacatcatgggatacctcggtttcattacataagccgatgacactgcaactacagacactgtctccatcaccaaccacgcttttcgacgactgattcccacaaccaagccatgtgacacaaacgcgacactaagtgacacaaacgcgacacaaaaacgacacaataacgacacaggcaaacaacatactacagatatctatgtttccagcaccttgatcgccgtccaaccaagtgtctcagctacaagaggagtccccacagttgccatgtcttctccatcacattttttcaacttactaacacagatgggcgtcctacgatctagttactaccataggtagcgctagtcatagacgggtgcttcccgaagagctatgagccaaacgactgcgtcttccgagggtgtcggataggcaccagtcaggccagagtctccaggggggcatctcaatcccagggaggaatttactttgtttacagggagggtgtgcgttaaccatgcccaggttccaagcatgctatgaactctgggacagagtgtcatagggagtgccccggacaacccgtgtctactggcgatttttgtctttagacacgacgctacaacccagtcagtttcaaaccaacttgcaatcacccttcgcgtcccaagaggggagtctgattgcacagagacaaaaccagactagcgtcactcacgttctcggcggaaccggttcgtgagatttacttttttacttgctatcgatgataattttggcactggtgatgttggagcataggagatgatgctcttggtggtggaagggaggagtggatttgggggcttgtttgcaagacaggaggcgtgaggatagttaggggtggtgggtggtggatggtagatgaggggagttggaaggtgacgaggggtggaagatgagggagttggaaggtgacgaggggtggaagatgagggagttggaaggtgacgaggggtggaagatgaggggtggtgggaggccgtaggccgtggattgtggatggttggagtatgtgagggagaaatcacttgaaccctctggttgtgttgccttctaatcacatccgtgtgtggagagaaaacactgcaatcttctgattgtgtggtcttctcaatcacacccgtgtgtgaggggaaaagcgctggaaccctcgttctcaatcacctctgtgtgcgagggagaaagtgctcaaaccttcgggttgtggtcttctcaatcacatcctccaagggtggtggagggaatgcaggagagggataaggcattatatgggggtgttggggttgtgtgagtgggatatatataaataatgtattgattgttttgaagctcatgagctgtatgttaactatcatttagaagcaatgcattgtattgtataaatattactgtattggagccgctgtctttttgacatcatctacgatcctttctcacagtcatctaagatccacgtgcaactaggctcgggttagtctgggctggggcagtttatatggtccatgggcgcacgtagattgcggcacatgttttctgccaagccaatggtgcgttatctctcttggcacatgcattggcatctgataataagagccagctgtgagttcaaggaattgtattcaatcaaggagcaccttgttatgaccgcgataaaaaacctactcagtggagcttatggtttgaccaattctgacagagtcgcgtgaatatgtgtttttctagccaagtggccgtcaacttctagtttctcttccacctaactaacgatcgccatggtcaattgtgtaaccaaacgacttgacaactcatcgtctctccagactgaggttgtcagcgttggcaacaacgctctaatggactggggagttcgaggctcagaagatcttcaacgcgtctgtctccaactgcacaaagtgtctaaaaagcatcaatctcggcacaatatcactctcaaagtccccacggtctccccgcccaatctgtccgacctccatctgaggtccaaaaaagaaaagttatcaatcaccatggccaacaaacgaggtctgtcgaaactctgcttcatggtaaactactacaactttcggaacatcaattcgtccgggggtgttcaagtggcttgtgggagagagagtccaatgtgaataggttggtcagagggtgtagatcatggcccatgttcaataaaagtttcaaaccatgtgtaaatggagggcgtagagcccctttactaacaggtttgctgctactcgcagcgtttactagttcattttgtctatctgaacattctgtatggttcggctcatagacgactcatgaccgactgaaaaaactccatgaccgactgaaaaagtcggtctatggcgcaaaaatacagcccactcgctacgctcatgggctggggctggggctggggctggggctggggctgagctgggaagggcgacaaaaagattacagcacccaggattctcgtatggtctcccactacaacactaactgggctctctggtgcttgactatgtgtgagaaaataaagtgctttgtgcgtaccagggatagggtaggtagtgaaatctgagttagtacatcaactctagacgatgggcgtcgcctgtgtagaagaacaataactcacccggtaactaacactatttctcggtggtcaatgcgtcagaagatatcaagacggtccgttttgcgtttaagccgagtgaatgttgcctgccgttagtaaatttattatgaaaaaccccactatgaatacatcagcctatactgatataccaagaagtgcaagggaggtggtcctgttccacctgaacgcgatttccgacaggcggcggtactgaagggctttgtgagagaggtaacgccgattctctctgcagtcgtaagacccaggtggtgtgtccgaggcagtatcgctttcccaactctagtaacctcggtagtgtgagacacactacccctaacggtaggacagccggacgacgatggcgcagcaattggcgaacgctgttataaaacaattcacttacgtgcaatgaaagttgtttgggcaataaacaataaatgtattagagccagacgatagacaacaatccagcagatgatgagcaggaaaattgagtaagatcgacgtggcaagaagagttacagttacgcagagttaataaggtgttgggagattagagttaccctgtcggatgactaactctccagagcgagtgttacacctgcccaggtctaacggggtttcgtcccgaagccctggttagaagaatcaagaataaaggccctgagcaaggaaggagccctgagcaagcccagaatcaacacgagcgagcttcgaccgagaagtaactctagtcgacgcagtggtagctgcagaacggacggaacgagtagccactgaagccgggggaagaacatgtggagaacaggcagaaaagcggccaggaatggcagggagagcagactcgcgggactgatgttccttcatgcggtcctggaactcaacgatggaagcggggtggaaaaccttgaggcggttgcggtggatacgccgcgggttctcaccgtcaacatcgttgacagtgtacgtgctggtctcagggtgacacgcggtcacgatggagggaccagtccaacgaggagtcagcttgttgtggggacggaggtcgtgaacaaaaacgaaatcatttacggccaagggatctgtatcagctgtgttgtgatgtttgtcgtagaacgccttttgacgctggcgttgcagggtcaggtggtcacgagcagagccaacttcgaaagtagaagcagcaagttgcaaggtgcgcagaaaagcagcatgagcggggtcgttgtgggccaggtcggtcttgccactgaggtaattccaggtcaggaaacgactttcgacaggcaagacaccagagacaccatacatcagctcaaaaggtgacttacccgtggatgaacgacgggtgcaccggtcagcccagagggcggtgtggaggtataagatccactgacgaccgtatttgcgcaggcagtggaggaggttttggtgaccgcgttccacaatgccagtcgattgaccatgagcaggagtggtgaaaacctgcttgatgtggaaatcttcgcagagatgcttaaaatcacccttgaactcactaccaccgtcagtgtagacccgacggggaacgccaaaacgagcaatgatgaaatcgtagaagaaagcggctgtggagagagagttgatacttcgtaagggcaccgcctcaggccagccagagaattcatcacgagcgacaaggacatactggtagggggcaatagtgacatttagccgtccgcggggggcagaggaaacatcagtgaactgaggggcagtggggaggaagtcggtgagggtggtttgagcagcgagagccttggcgggatcagccagatcggggtactccttggtgggaccatgaacagcgggaaggtagaggatgtccagctggactgtctcccaaatgagacggggaaccacgaagtggagactcgccttgagaagaccatggttggtggcttttgcacacgtgccgcatgatgcacgatgggacttcacgtgatcagccatgcccggccagtaatagaggcgacggagagcatgaaggatggcagcagcaccgcggtggccatattgttcatgggtagctcggagaacctcagacacctccttctctgtgaagagaacacgtcgatggagaccaggtgagctgatcagtaggagaatgtcgtcaaaaatgaagaactcagagcagatttgacgcagtctaggcggaatgtcaacaccatctcgatcaagatcgccggaggcaatggtggtgaaaatgagatcgagagagatgcctttgtggatgaaaacgggctctggaccaatggacaggacagtgatggaggccacaggggaccaagtcgggggcacaagcggagcaagctcatcagcttgtcgagctgtatcagcaacaggagggcgaaaatcgacaggtcggaagtcagaaaatttctcacgactcagccaatcggccactggattgtctcggcctttaacaaatcgaacctcgtaatcaaactgtttgatgtaagcaaaccaccgggtgaacatagcgttagggagttcaactcgggattgctgcagtaggaaaaccagggcctggttgtcagtttcgatcacgaaatgaacgccagtgacatagtgacggcacttctccaaggcacgttttacagcaaggcactcagtcttggtggatgcgtaggtacgctcagtggggttccacaaaccactctcgaaacggacggggcgacgggcagccggagggccaacactgacgatgtgagacattactgcgccccatccgagggaggacgcatcagtggtgatgacaataggtaaggtggggtcgtagcggtgcagaaccgcagggctcaccatagccttttttagcgccataaaagcagactcggtggcctcggtcttggtgatcttgagtttgccagccttctgcgcagcggagatgcagtcgtacagaggtgcagcgatactgctgaaatgagggatccacatgcgaaaatacaccacagcaccgagaaaagagcgcacaccacggacagtagtggggaactcgaaagattcgatcttctcggaactgccaggggacgggaagcggccttcagaggtagtgaggaaaccgaggaactcagcctcactgacgaaaagctcggccttgtcgaaagacacagtcagacccgcttcatagagattctgaagcacagccatgaggttgtccatgtgttcgacgatgtaccggcggcagcccggaaagtcgtcatgcatggctccgccatagtcagtcttaggcccgagaacgccaatatcgtccaagaaaacaacagcctgatccggaaagaggggcccaagtacgcgcagcatggcacggtggaacaccgctggagagttgcaccaaccttgaggcaggcgcgttaaccgataggagccaaaatctgtgttaaaagccgtcaagtcacgggactcgggagcaatctccttctgaccgtaaccattcttaatgtcaagcagggaagttacagcacgaccacagaaactctcagccaggaggtccgcgttgggtgggtggaaagcatctctcaaggtgatcttgttgaggccctggcagtcaaggatgaaacggtatcccgagctctttttgctcacgaggaaccaggcgttgcggtggggggaggagctgggctccatctggccgttggcgagacccttcatgatgatgtctttggcagcgccgaccatagccccgcggagagggaagtgctttgagttgataacgcctccctcttccacgtagatcttggtgggctcctcaatatggtgactgaggacaccctcctggtcttcgttgaaagcccagacaccctccatgtccgacatgcgatggcgacagagagcaagctcggccgggaaaaggactggagcaagtttggcatcaaattggcaagactcgtcgccagagaagttgcgatgtcgcggagaaggcttggagccgtcaccgacaggaaaggaaccgtccgggcgaagcttatttagaggcagagaacgcttgtgtagcggcttgtacatggcattgacggagacagataaagaatgcagagagtcttcaggggtgatttcttgggcatcactgagaacttcagcaaggtagagctgttggcgcatggacaggtcagtatccggttgaacctgaacgatggtagccgagtcgccaatgtcagccatgatgaaaacagtgttaccaagtacacgacactcacgtacaggctgctggcagcagctgcagggcgatgcaggaggtggatactggaaaacactgtcgaggtcggcagaagaaataaaaccactgagagcatgagcgtcggggggtctggcatgaagagcattgtctgcaaggttgtcatggaaacggtacgacgtgtagctctcctggaaaacggtgcctacatctgacaaggcggccgagactccggacggggcttccgacggggcttccgagcctgaagaggaggagcagagctcgttggagtcatccacagatgaggcatcggtaggcagtaaaggtccaagcgtaccgtcgacgggagcggaggtgtgcccaggtgatgaggagttgggctcgccagagacatcaccgtggtgcccaggtgatgaggagtaagactcgtcagggtcatcacgagggggaatgccaaggggatcagggccggagctggacgctagagccttgagaatggcggtggcagcgctcgaaggcgggccggcagactcacagtcatcagcaaaggatatggcaaaacagcctgccgctgtttcagaacggtgggagtaagatccaggctgaggccctccgagagatgaggcgtcaaggagatttgttgcttcatcaacatcaccacagagtgagggagtgggtcgaacgtgtgccatgacgttttggcgagacagcttggcagcaggaaacgcaggcacaggccggcggccgggcctcacaagacggtcaagcaacccaaggtgagcaacaaggccagctgaaggtctgtcactagggtagcaccggacgccagggttaccagggttctccactgaagcgacacggtaacgatcatggtcgaacgaaatgcgcagtttgctgatgtatccggtgccgagaatacacttcatgctgcacttcatgacacaaaatgtttcaagagtaacgacacccaggaaagtgacagggagaagcgcccagaaatcaacttttaccttggctccgtttgcgactgtggcgtgggactgtccgtcagaaaaaacaatcacccggtcaggggtgacaccagccttcgcgagtacaagggcaaagaaatcagtgtcgatgacgttgttagacgagccactgtcaaaaagggcgctggtctgttggtcgaaaagagcaatgttgtcggtgaagtggggcgagagtggcctaccaactttgtcgtcgtacagctgacggtcaatggtggtgaaaacctcctgaagacgaccgaaggtgccagagttgagctcatacggtgtggacgaaatcacgttgagcgcaagatccatggcacactccatgagatcgtccccgagctcaagagcgatggcttggatgtcaggacccgcaagccggtgccgctggtgacggaagttcttccaaatgtactttgtgaggtcagggcacacctggagaagctcaaaaagaacgaggccatcaacatccgacgccttgaggatgcgctcaaacaagtctgctttttccgattccggcagagcatgaatggcctcaagcttgaagagagggagacgcccagccttcagcaaggcattgtcgtaacgaggatgatctctggtgaagagagccttggagtcctctaggtcagacgggaggcggtccagagcatccttgtaatcttttaagggtgcattctccgcaacggcagaggcatcgtggatgtggttggtgacacgggttccagggctcacgtagtggttatcacccagacggggggggtgaacagccacacgagagctggggacgtcaacaacagcgcccgtggaggatgcggagtcagtcggccccactgaggagggattggctacagccttggttcgcttagcagtggggggagcagcggaagataccgtagaagaagcggcaccacgttttgtcgcttgaggcaaagcaggcgggggcatgtcttcacggacatcacgacgggggctgcgtcgcggcaacggagccactggtctgtcagggtgcttgctgtcgacaacagttttcaaggcgttgatgttggtcttgagagactgtcggcgaggatcgccttcggtggcgtaagcgggctccatgaggtcatttcggactgtagcgaaacactcgtaaagcttcgtaggcaatactacgttgtacttgttgagcaatcgctggaccgcatcaacaaagtagacacggccggcaactggggaagacggggccataacagcacctacaaaacccgcttcaagcgtggaggctttgaacgtgcccgggggagcagttaagcgagctacgagctgcatgaaggctgggtgtgccacaaggcgcttcatgttgccactgtaggagcctgacacaggcgcatcaattgcgtaagtgacggggaggggtgtgggctgttttgccatctggagaatgtgctggtggattgcctctttcgtgagctcaagctgggagtcagtggagtcaatgatagtgcgaggctcgtcgtaggaggaaaacgtatcagacagaagatctcgaggcacccctcctagacagacactgaacgtgccgggttggagaaggtcctggaagtcataaccagacgcagatgagtcagagtcatagctgttatccaaaggcccgcctgggtcttcaacgtgtacaaattcaacggcatttacgcggccagctagggcaggacgccactgcgcattgaaagttcgaagtctaggctccataagcggattcgaccattccttctgcttccaggaagtgtagagagcgctctgttttagagggaagtcagcatcaacaggcgatagatacttttcaaaaccctggtagccaagtcgggtgaaagacttgaagctgccaaggtacttggccttgaccaaggggctgccttcggagtcatcgcagttgaccagtgcatgggcagtggaaccacagaaaacacaaggagccttgtcagctgcccaggaggttgaggcatccgaggcacggattgtgggtttctgcacagtctcagttgagacagggccgtcggcaggcttcctggtggaacgaccacgtcccgcaacgtgaacgacgactttgtcaggttcaggcgtggaaggctcaggtggggcggaaggctcgacccacatccacacgtcttcgaaagataccgtgtgctgtcgccatctcagaagagcctcatcattgagatcgtcaagtcgttggacatgttgggtgatcatcttggcgaggggctggatgagctccgtggcaacttgatggtcacgctcagggtcggagtccatgccaaggctcagccaacgagtgttgtcacgagggatctcgcgtccgagggcggtgcccaggtgagtcggagcgagcttctgcaactggagacaccgagagagaaccggcagaggtgaggaggtcagagcggtgctcagagcagagaggtacgcacgtagtgtctcgatagagaaagcggtgtggtaatctttgaaccggaaacggagttcctcctcttgttcagcaaaggagacagcaggttcgtggtcaaacccgcgctttcgaaaaaggtcccggaggagacgttcgcaagcggtgttcagacgagcgtgggcacctggcttggttgattcatcagcagtctctgcttcaaaggtgcttcggagttggaggtactgttgatcgaagaggggctgcttatcgttgacaccgcaccaaaggtggaaagcccgagctctggtgctccaacggatgtcatcctggagtaggataaaggtagccacccgggaatcaaaagatttgtaagcgtacaactgttttcggaattcttcgctggacaaggaggggtaaacctcgttccggatgatggacttgagggcgtcggattcttttcgatagtcaacagaacccgtgtcactggcagcaaagtccatgccatgtaggacagagttacccttctggggggtgtcgggttcaaattcggaatcagccttgccaatacgggaaatgccttcaagggagctggtgctcgggggtgagtcgacacgcttgctgaggttcgcgatggtttcgtgctgggccgacaccaactggtgcaacttttcaaactccccagcctgatgtgtcttgaaagactcatttgactgcttgagctcgtctaaggctgagcggaattccttggtattaaccgcggtagcgagagtagtggtgatctcctggtgggagagcgtcaaggcgtccatcttcgcggtgagagcctggaactcgtcttttgttactttcgacatggtgaaaacgaaagaacggaaagggaagtaaaatacgctggtacgacagtaaaggcacaataaatctggcaggctatcactcgaaacaaaaacgaggtgtcgtccaccagatgtgagaaaataaagtgctttgtgcgtaccagggatagggtaggtagtgaaatctgagttagtacatcaactctagacgatgggcgtcgcctgtgtagaagaacaataactcacccggtaactaacactatttctcggtggtcaatgcgtcagaagatatcaagacggtccgttttgcgtttaagccgagtgaatgttgcctgccgttagtaaatttattatgaaaaaccccactatgaatacatcagcctatactgatataccaagaagtgcaagggaggtggtcctgttccacctgaacgcgatttccgacaggcggcggtactgaagggctttgtgagagaggtaacgccgattctctctgcagtcgtaagacccaggtggtgtgtccgaggcagtatcgctttcccaactctagtaacctcggtagtgtgagacacactacccctaacggtaggacagccggacgacgatggcgcagcaattggcgaacgctgttataaaacaattcacttacgtgcaatgaaagttgtttgggcaataaacaataaatgtattagagccagacgatagacaacaatccagcagatgatgagcaggaaaattgagtaagatcgacgtggcaagaagagttacagttacgcagagttaataaggtgttgggagattagagttaccctgtcggatgactaactctccagagcgagtgttacatatggctgatcggacgggaagccgtattttcaccaggatatggccgtaaccaacctgcgccgacccggaatcgaaccgggggcccatcgatggcaacgatggattttaccactaaaccatcggcgcttggagatagtgtttgtcctaagtatgtttgtcatatccacaatcctgcttagtaatttagtaatcccatattagtcagggttagaattaaaaaatcattagaagtagaaccccccctcctggctaactaactgaaatatacagcaatttagaacgtctaaggagtaccttttagaccccaacaatgcatgtcggctcttgaccatggacaattctctggcacaccccgcaaagacgttcatagcatttttacaagtggagtcccacgcatgaaaaagttagtctattgacctcgggcttttcttgtcttacggatgggcacaactatgtgagaagcagatattcttcgcattctgagaccgtggattgactctctcgccctaacccatatttcacaagcggttcggctaaattaaccgttccgatatatggttatcaagccatgttatgcttatcttatcactgttcgtctccgggttggattcggataacagacttttcttattgtgggggaaaagggtcgggaatcgatatccgctgcattcctgggagtctaaagtggagcactgagtcacgtggtttgaaggagacatgcggagaatcatactgatgtccagggaaaaactaattgctgccaagccttggagagatgggtttgactggtcatctcttggctgcttatcttgtgtgtcataaagtcgagcagattacaaccgacgagcctgtggtccaaactgaactttaaagcagaagatagctcgtcgatgggtctgtattatgcatacaaagaggggattgcggagagctgaagagattttacagcgttgaaatgtttggtatcgtcctgatcaacctctttgcccaccctacaagtttgtagacctttttttcccggatttgatagtgtctttctaatgctagagcagcatgagtagatcaataaactaactttcggatagcgcttatccccacccttttggaccgtcctggggattcatatataagtcgtattgctgccgtgtcttggtatctatcatcatgaagctgtttaaacgagaagcgccccaaggaacagtcagaactagctactttggaagtagaggcacgcggctgcatcggatcattgcagccgtggctggaatcggcttcttgctgtttggatatgacaccggagtcatgggcagtttgttgaccctgccgaccttcattcaccagtttccaactatggatagcacgtctccacatctggatgcaaagacaaagtcgttccattcgacggtccagggcacagccgtggccatctacgagattgggtgcatgttgggtgctctgtttacaatgtggggaggagacaagctgggtagacgaaagataatcttcattggctccataattgtcaccattggagcgattcttcaatgtgcttcgtattcgctcggtcaatttgtgactggaagagtcattgctggtattggagtcggtttcactacagctacagtgccaatgttccaggctgagtgtgctcgtcctgaacggagaggggccctggtgatgcttggaggagccctgacaactggaggaattgctctcagttactggatcgactttggcttttatttcgtcaagcgaaatgactcggactggagattcccggtagcttttcagatcctcttctccctcattctgtcgtgcacagtcctgtaccttcccgagtcccccagatggctcattaagaagggacgctatgaagaagcagcaggagtgtttgcagccctggaagatgtgcccattgacgacatctatgtatctcagcaactcatgcaggtcaaagagtcgctcatggtaggccaacttgcacaggaaggcattgagggagatgaagcacgacgacgaatcgcttcaggagacgtggagcttggagaagagccgccgttcaggaaacagttggttctgctcttcacctttggcaaaaaaaaacaccttcatcgagccatgttggcttactctcaacagatcatgcaccaaatgtgtggaatcaacctcatctcatattacgcagcctacattttccagacttctatcggtatgagcccgctcaactcacgaattctggcggcttgtgatggaacagagtacttcctggcgtcctggatcgccttctacaccattgagaggttcggacgaagaaagctcatgctgtttggaaccattggacaagcctgtacgatggctattctagcaggaacagtctacgcagcatcttcagtaaaagacggtggcctagacaaacctcaggctggcattgcagcagcagtgttcctgtttgttttcaacaccttcttctccattggctggctaggtatggcgtggctgtaccctgcggaaatcgcccccattgaaatcagagccatttcccagggtctgtccacatccggaaactgggtcttcaatttcctggtcgtcatgatcacccccgtggccttcaactccatcaagtggagaacttacatcatctttgcgtgcatcaacgtcgccatggtcccctccatctacttcttcttccccgaaaccatgggccgatcgctcgaagaaatcgatctcattttcgaagactccaaccccagaactccttgggacgtggttggtattgcaaagcgacttcctaggggtaccctggatggagttgttccttcagacatggagctggagaaggagatcgagcatgtcagcgtcaagtctttgggaggtgccactattcgtggatagttatgctgtagtatatatttattctttttgtaccttggtacattgttatccttgtgtctcgcttgtacttatggcaccgtcacaggtcgtatgaattgtaagctgcactcggtctcgttgaatttttttccacatatattacaatttacaaaatgtactaatgagtacggaaaactagagcagagcggggaccttaatctccgctcggcagctgttgcagtagttttcaatttgttcaaacttgccctcgtccagcttgtccttgccgtacaacgggtcagcagccactcgtgctgtgaaccgctcacagtttcggacttcggatcgaagccagttttgccactcttcaatggcaaggtctcggtcagatcggttgagcactcgcaggttgaccagcagctctcggcgcttgatacccagcatgtaccgggccttttggatctttcgagaggccgaccgagaagcaacatctgagaagtacttgttctcaaaaaacttgtcttcgagtccgataccgtcgtcgcccttgaggatcttgtcagggtccattccaaacacccgagacttctccagagacaaatacttttgcagagcgatggaatccgtattgttggtatccgaggggagcatcatgggatccagatcattgataaataccgctcgatataaagtgtcgcttggagccgccctacgggcctcctgatgttgtttaatgtgaaagtatgtgagacgaccagatagccacaggttggacacaccagacacggccagaagcacaatcagcacaatgtgaggagacagagacttgaagaagcccttcgcgagcttcacaatgatgatcatgaacgccgtgagagccgttagcaggaatgtgaagatggattcggacacccaggtgaccagacgtcgtcgagagaccttgagcacatcctgcgagtcctttcgctccagttcagcaagctgctcgggggtgggatcagtgtcaatctgacccagcttaccgtacatgatgatggaccggttggtggagtcaaaggtgccgactcgtcgcagacactgctgaatgagtcgaacgtgagattcggcttcatgctccatgtatcgcatggccacagtctcaaccacagacttgaacagcgaccgcttcttctcggtgtaaacgaggtcgtcccaaatgcacagacgcgatcctccggtgtcgttggcggtgatgacaaaccgcatggattggtagaatgaactgacgtggctgatttcccaggggtttcggctgttgtgcaccacgtagcacacgttctcgtccatgcgctcgataacctgcaggtttcgagacaccagggtgccggtctccattagcgatcgcagcttgagatcgtaggtaatgagtcgagatagagtcttgtcttcggggttgagcatccacctggttcgtcgcgaagaaatcaccttgtggaaacgcgagtaaatgtccttgaacattcgcgacttctggccaaacatgatatggaacagtgccttggggggacagaggaactccctatcaacaaccttctgtgcagtcgacgaatgcagagaatagtcgggagtatcaacggtcttggacgccactgatctggcagatgaggaagttggtcgcttggtggccttgacctccttacgcttgtttcgcagatcccgataccgcttgacgagatgctcggacagctcttcctgcgagaacttttcgtcgtgttcgccctggacgttgtcaatgtatccaagatcgctttctcgttcgtaccagccatcgttctcggtgagaatcttgtggtcgctgtctccatcctgcaggatgggcagcatctcctccagattacggggactgtctgacagtacattggacagaatgatctgcaaacgtcgctgaacaagccggccagagtctaggaagactcggcatctcaaaacagctccatcagtacccaggacgtacaggttctcccaggcattgtcaggggagccctgcacagatacgatttcagtcagaggcttcttgactgcacaaacaaaacccagagagtatgagtagacgtataggtttttaagagtgacaaagactcggccgggaagctcctggcgaggattgggagaccagagacatcggaagacagtaaccacacgatcattggggtcgtgatcaacggcggtctggaagatggctcgcatctggaggtcctgggacttgagctcgatggggtagttttcggggaagggatctgtctctgtggtagggttttcatccatcttgcgctggaactcaaccatgttttcgtgagaagcaatggccacagtcgagttcttggcgtaaagcgcccagttgacggaaccccacacgttggcggtaacggcgtttggcatgtacgacggcttgacaaacgccgtcgacacaattgcttccttagtcatccgggtgtagatgggggtgataatgggaggcgaaggggccagcgatgtattgaaaggtccaaagccagagaagttgaaggcagacttttcgccgtgctcgttggtttcgttgccgtcaataaaggctttaccagaagccatcagcttgtgcagaggagtctggtgaacatggtgttcagaggcataggcatggggacctccgaggtaagaaggagaggtggtatcggtagtcttggacgaagtgtgtgccatggcaacatcaatagaggttccgccagaagaggcaaactcgggaagaggcacagtccacttcttgaatgccagagaagaccggtacggcgactccttgtccagggactgctgtttggcgagctcgaaggccacgagccaggacttgaactcggtcagtgactcggcctgggcaatgagtgtcacttcctgagtctttatctcgaaacagaaccgtctttcctcggtggggagctgcttgatggagcacaacagcactccaatcttgtcggactcctcgacaaagtcgcactcggggggaggcgacacgttcagccagccaaacaggccggccttgacaaatgcccatcgtcggacccagatagggttcttttccgctggcgagttggtcttcatcagcagccagccgtgcttctcgatggggtggttggtgaccttggagtccacagacagcttagtggatggtgacagaggctgatactcagcgatatccttggatggcttggctgcggcaagcgtgctgtcctcaatttcctttcgggccttgccaatctcccgcacaatcaccttgttggcctggtggatggcgttggaccagtttcggattcggtgcatttcgattccaagtcggaagtacgccgagccggcatgctggtgtgcgctgtcgtcgtggtttcgggcgtttgaccgccaggtgtctgtgatggtgaggatcagagcccggtcaatggcatggtggagtcttaggtagccagcgcagaattcgaacgacgccttgatgtaggttgctcgggcttcgtaaacggccattgcctcgtcccgaagatgcgagggctctctggtcttgttgagagcgaggtacttggcctgggcggcgtcgtacttggtttgggctgctcggaacgccttgactgtctctgagaagggagcaattcgctgtttgagcagcttgacaagaggttcaccaaggtgcgtgttttggccgttgatgtttttcatggcgttggtccagaagagcttggagccctcggcgaaccgtcgcagcaccagcatggtgtagtcgtgatccaccactccctcggtcacgaacgagggcatgaacttgccgaccaaattgttgatgacggcctggagggtgtgcatttctgcggtgacgtcgtggacgctttgcacaaagccctcgagccactgtgaggtgaccgccaactgggaaataacgtggttaacggtggctcggaaagagggcgagtccaacgacgcctccttgaagatgaccggaatcagtgtgatgggcatgtttgcggcggcgttgggcttgagctggttggtgggcacgccctggtcgttcatttcagagtgggggattgtggaggagcctgctctgtcgccggtatgagatttgggggacgacacagacgcaattgagggcgccgtcttggaggccggcgtcgcggcatgcccgttgacctcgtgattgctggtgagcgagcgtcggtgttcgggggtgcccagaccaagcgcatgggcgtcgtgggcgtcatgtctgctgccatgaggatgcagaggattgtggggatgggggtctttcggagccacggggatggggtttgccaccgagtgttgggctgctgccaacgcagcgtttgattcggacactgtgttagtaacggtggcggctgttgttggagccacagacggctgtcggctgacaaggtcatgttgactgttggtgagcgccgcggacaagagtcctgactcctgatcctgaccctttttgccggctgtttttgcacacgtgtgctggtcgtgttgcagccaacttgctccgtggttttcttactcactggtgctcctcgggtggttctggggagtttgtgtcgtggttcggcgtccgagtcgaggtccttgtatgtccgaccaacaagattgctcaactctatcttgcgggattatgtatgcacttcgtgggctgggggtctacaatgtagaagtataagaggaggagtggatggggacggtgaagaagagaagaaagactagaagagggccaaaataataaaaataatatataaaaaaaaggtcaggcaccagcacgctgccgcttaatgcacatatagtgcgctctaactcccgctagccagtttctccaccttgacattgttcctggttaagtccctctaagtcgcactctgacttccgcttaacgtacatgctagctgtacaaccgatgttagtcgagaacaaaagacggggaaggagctgtcaaacgagaaccacatggcattactaagcaacatagccccgaatttcctttgtcgcgtggtctccggtgcccgtaagcccatctacagccgaggtagacccggctactactactgcgtgcctctcaccatacgatacattaactttggcctcacgttgatccaggcttttttgagtattggattttcccgtttgggctggaccagtgtgtagtgttagccaatagaattgggctatggacggccacagatacggacaagatagattatgatgactgtttaccgtactttaccttcatttgtcccagtcatccatctcttcccatacattgctcagacacttgctacttgcttgttttttttttcagatacaggcagtcatctccccatgttcttggcaacgatcaaactcagctgccttagtctgttcggacaagtctacttgtagtacatactgtacttttgtagctccttgtacttgacgcaaagaggttttatcaacatcgggtctgatggagatctggtggtttgatattacgtaatctacctcatttgctcgtcaaaatagcaattcaacacatcaacaggcgattgtggatactcgtcgataacctcagttacactcgagacagatctggttcttgttcttgttgctgttagtgttagcaagccaaaaggttgtctggttggagtgcgttggagtgcggttgagggaagggcggtcagtcggaatggagactggttactgcaagaatatagagaaactgagtcatcccgtcggtgttccatgtctgtcacgtcactgtcccttacatccacgcgcctttatcatgtccgtattcctcctactcggcacgatatccactgtcatacaagtacagtaccaacactagacatggtccgccacccaacccaatctacagtatccagctgagacagaacccctcgcttcacctcggttcaggctgctgtcttagtcttggtctgtagaatcaggcaaccaaaaagaaattacggtcgggtggcggtacgagtacaagtggaccttttgaccattgtacttcactttggtgatcgggtggggggactcaacctcgtgccgtagagtacgagttcgtcaatacactcgccgggttctcgtattttggttcaatttggttgaatatatctcaatgctcacgtaggagccgtttctacatatctgctctttctatgatccgctttatgatttgctctttctatacatttgctctttctatacatttgctctttctgtatgatcagctttttgctgactcgtcgcgatataattggcagacatggtgtggaggtttgtcgtaaaccaaggttgacacgaccccccggcctgtaactcctgcaaagatcgtaaacatgacccagtgcagttatccctgtggtcgtgaatgtggtcacgtgaactttgaatgggacagcagtcatggctggtgtgtatgagcatcacgtttcatcttctgattcctcatctcctgattactcatcagcacgattactcatcagcttgattactcatccgaagagattatgagttctggaaaactgctcgaacccatcgacatgggcgtagatccgacttttaaaaatgcagtctcatttctggtgtatttctggggtatttatcacggccttactccctcactacttgtacttatataatgttcgtgacaagtaaacccaccaacgcagacccaagtatacacatctcaattgggtgatacaagacacaaatgcgcaaaatgaagtcgcggacagcaaaacacacgtcatagaatccactccaacaggtaaatctcaccctccgctcgcaccacccaccccacacttggccctccaagccactccagggtaaccaaataaacttcccaaccctacctcttgccattaccctaccgaagtgttgcagtcaataaaagaaaaaagattggcataacttgagacctcttttttttctctcctcacatacgacaagacaatgatctcaacacgacactgaatggtgagtacccctcttttacaaacccccctcgcgcagcaaggcaaaatgattaggaacatattttctactgaggatgtaaatgcaggacaaatcgttaaggaattcttcgtttatgatcttagtgcaaacggcatctcttcttcccaaacacttctaacatcaggtgggtatcgacaaaattgctggggatttgattctttacaaggattgagtcttttgtctcatcaactgatgaaattttcacacacttttgcaggtgaaaacgtgatccaagcaaaaaacatgcatcaccatctgacattttgttgaaatatctttcagttttcgacattcgttttgctaacattagttaccttgagtttctaatacccctttcccatctgatttgtgagtacctccatcgtttctgccttgcttgtgtgagactataatgatgacaaaaaattttcagttctgcttctgaaagagaatgaagataacaaaattaccaaaacctctgacattctgtttgatgtttcattgccttttaaaccctttctaactccagatttattgcactcctcttggatgcctccgataccctgatttatagctaacgtattctatctaaaaccgtgacagtaacaccgtatcgcagagccacgcaagttggcatgctcattggtttgctctataacagttaatcgtacttgcactgtatcacagccattgttcatttctggtactcgcactcataatcgtacttgtacttttcaatatgttaatactatggacatgctataattcatacttctccagcgagctgattgccagagcttcaggttcctcactcagaaagattacgacgcctgagacatcaagaaatccttcacgggcttgacactattgaccgcatcaagacccaacgaccgcagaccaaccaccagcgggtttcgggtcgagtacaacttgtgcagcttgtcgaccacgcccagcagcttgtggttcttaaagtactggtcggcccagtagggctccagggtcagggtggatccaatatcggctccacgccccgcagcgtttcgaatggcaatggccagactctgggcgtctccctggcccatgttgagaccctgtcctgctagaggatgggtggtgtgggcagcatctccaaccagagccacgttctcggcaatataagtgtcggcatgcttcatcttaagagggaaggaggctcgcgacttgtcttggacagcaacaatggggcagggcacgtcggggttagaagatcgctgagacagtctgtaaggagcgtcagtcatgatttcatcgggatgttcaaccaggtactcaatgtcggtgggctcgaggttgaatgcacagttaaccatcatgacaaactgctcgggagtcagctgcttgagctgggcggccatcttgggggtggtggaccagacgagcgagccgaatctgttaggcagaggaagaagagcaatgggaccggtggggaggaatcgctgccatgccgactgctgctcgttggccagacgcacggtggcaaccagaccgtgggtgttgtagtcccatcctcgtgcctcgataccggaaaaggttcgaacaggagagttggctccatcagcaccgatcagcagatcagtagagatagtagaaccattggagagcttgacaaggggcttgttgtgcgattcgggtgttcgctcaacgccctccaccttggtcttgtccaggatcgtcagattgggcttatttgccagctgcttgagcaagccgttctgcaggttgaagttttcggtcatgtaggcgatatctcggccctcgcccatcaattgggtggtgttgaactgcaccttagagcccgacactccatcccacgctgtcatgtgtctgtaggcctgaactcggtctcggttgacatgttcccacacgccgatcttggtcagatactcgaccgaagagggggtcagagaactgactcggttctcaaaccgctccatatcggggccccaggtcttcagattgtccagagacccaaactcaacaagagtcacagacttgttgaccgtctcagggtagtgtttgagggcagcggcaatggtcaagccggcaggacctcctccaaccaccacaatgtccgagtgggtggtggagggtttgggagcagatgtggtggtggagttccatcgctggactcgaaaaacagccggccgcagccgttgcaaggtcgtggatcgaagcatttttttttttgattcagcctaagtgcactggtagaaattatatccaaagcctaattgtagatgatggcacgattaaatagagtttatttaggggatttggtgggccacgactgtattgggggtgttgtcagaagtgacgaagatccgctcgagtgtagcagcgtctaggataggacggaaccaacgtggacagcttgccagtttaggattactaatcttgaaaagtccgagtttgtctacagtttatctacagttcgtctacagttcgtctacagttcgtctacagttctgtcggctgcggttgtagtcccgacttgtgcaaaaaataccattactaagcatacatttgggaaattgtaagggtatttacttgtcaaaaacgatgccaaatgattattcagctcttactcatcttttagatactaaacacatgttttatacacattacttggttgctctatttaaagttcacaatctatcaaattacatacgactgcatatacctcactagaccattttgacaacactctcaacaacacacacaactcacgatgggagcgttattatcgattcctctggcggtcatcccgtccgtctcggccatcggaacttgggcagccacctgttgcggcgcagcaatcggctcggccatgtgttcggcctgcaacaagtgttcttcttctatcgccactcgagtgggctacgcggtgctcttcctggtgaactcgattctgtcatggatcatgctcaccgactgggcagtcaaaaaactggagcgcttcactctcgattacatgaagttcaagtgtctgggtgaagagtgcacggggtttgtggcggttcagcgtatgaactttgccctcggagtgttccatctgataatggcgctgttgctggtgggcgtgcattcaacgaaaaacccgcggtccaagatccagaacggctactggggtttcaagatcgccgcttggctggctcttattgtcctatgcttcctcatccccgaaaagttctttgtggtctggggcaactactttgccatgatcggctcggccatcttcattctcatcggcctcgtgcttcttgtcgactttgcccactcctgggccgaacagtgtcttgaaagaatcgaggagacagactccggaacatggaagttcattctcgtgggatcaacaatgtccatgtacattgccagcatcgtgctgacaattctcatgtacgtcttcttctgcacttcgggctgctccatgaaccaggccgccgttactatcaacctggtcatgctgatgctcgtcaccctggtgtccgtcaaccaaaacgtgcaggagtacaaccctcgagccggtctggctcaggctgcaatggtggccttctactgcacctacctgactatgagtgcggtttccacggagcccgatgacaaaaactgcaacccgctggtgcggtccaagggcacccgaactgcttccatcttcatcggagcgctgtttacgtttgtggccatcgcatacactacgacccgagccgccactcggtcttcggtgattgagcctgagccagagtcgcttgtggacgacaccgtgtacactgaaccctccgctgtaaccatgcgtcagcaggccatccgagccgctgtggaagaagggtctctgccggagtctgcgcttcacgaacaggagtgggagacatttgaggccgatgatgaaaagtctaccactaaatacaactatgttctgtttcatattgtgtttttgttggcgacccaatggacggctaccttgctgaccatgaacgttgagaaggatgacgtcggcgactttgtacctgtgggacgaacctacttttcttcctgggtcaagattgtcagtgcctggatctgttacttcctgtatacctggactctgattgctcccgtttggttccctgatcgattctcttagatgcccaactgctaaccctagcgcagcgagcagagcagaagcgtcatcttcttgtgacgcgattgccttctaacgattaatgacgtcgggaattatggccatagaccctcccctctcaatctatgcctattttcttataacttatatatactaatgacattgtggacgtgaaaatgagtgtcaaggcagcagccacagtggttgttggattgacttgcgactctaaccacttactggaaatccactaatgtattccatgtttccagcagtgagcaatgtgcagtacctacatttcgctggcttctagtggttccagaaagtcatggttggcgaaatccgctagtatacactactgtacataggtacatccagtgcgtgcgaccaggggttgagactaccggcaccggcaccggcaccagcactgagcactgatcggagatagctcaggtggtgtataatcaatacatccccggtagttgtgtacatcccggtagttgcatcgttatgtcaccagaaccagtatcttcaaactacactcgtatagcacggcacggccgacacggtgggattgcaatagccgttgttagcacgtttatctgaaactagagagtcatgccattacggtatcgtacggtattatcggcagctagtattgtactaacgcttctacaatagtagtatcaacatatgatgcactacaagtactggtaggaatgcgctcttgttacagtgtcgtactcgtacatacaaagccccgatagtgtacgaagatacgtactcggttcaccaactacccattacccaggcatttctagccgatacgtaattaatagcaactccaagcaagggacaaggagccgctggcagctttgtgcccttgcggcaatgcatcagagatcgatacgacgggagagagcagttgttccgagttttatactgcgggtttcagataattaaaacgtttgttttggcggtgatccgtggtgaagatcaattgacccactgttggggattctgcattcgagtatcaacagaaggtacataactgctactgtactttgctacccctaccccaaacacagcatcatcatcctcgactgtacagacccagacccagataacattccagactgtcccattgagagcaagaaatgcgggtctgtactttgacgcacagaccgcatcgtctatgtggtttttgtcatgttggtagtttggtttcctttttggcccaacaatgaccggggcggtttggagcgtgtgtttgacttacagagaacaaaaaaatgatgtcagaaattccagcgtgtacgtaatctcctcctccccaccccccgtcgcccgcggtcctcggggcgtgtcacgtgactgtctcggtatccgcgtctctcgtatcgtgtgtctagccgggttgtttattgttatgggtgcctaactgtagcaacaccttaatgtgtccaaggttctagatctagggcgggaataacggaaagatgtttgttttttctgacgtgccaaatccagtgatagccgagatgggggggaagaaaaattgccccatacggaagaggcggatctggggagttgattttggcagattgccgagattgtcggcccgcgtcgactcgccagccacgcctctaccccgcccacatctctaatatgtgagcgcgcccctaggtcgcgtacaccacgtgccaacatgagagacgcagtcttgttatggcttgttctggcttgttctggcttgttatgactctggcgtgttttggtcgcgtgcatgcaagcccaaggatctccgcaggatacgagccatgtatctttagtgtgggaatggtaaacagtatgtgtggtgtgggaatggttgtaggaggggcttggagacggtccaggtacagcgggtgtgcccatgaatttgcccaccaggggcgggtcgaggaaggtggctacttttaaacaggacgtgttagactgttcgacgcgtactatgggtacaggtacttggactgtagcggtataacaagccatcgcgatccttcttgacgatcatagatggttgtagatgataaacaacggtagtgtcctacaagtacttgtacaagggctttgagtctactcgtacaaacgactgcctcaataaagatactaatacataatattacaaatcgtgaatcataaataaagacctggaggtcatgcgaagacgacagtgggctgccggagacacctgacggtgtatttgcagagtggttaacagtttccaagctgcaacaagctcttggcagctcccatgctggcgggagtgcccttgagcaacgagcctgggggggcccgcatgggggtttctgtggcggacggctttggagacgaggcctcctccagcgcagccaagctcacgttggtttgcttggtgttgattttgtaaagggccaattggagccgcatcttgagccggtcggcgtgctctcgaatcttgccgtcgttgccgtccttacactcctcctgggactttggtggcagcaacagaggcgacaggatatcctgtgtgaagagctttttgttggggccctgctggagcgacgatttgcacactccccggggctttcggtatggggatccggtggacttgagggggctgagggcgcccatcttcatgttggagatgtctccgagaacctctctgtggacggtggtcattgtgtgcaagaagatgtgaaatgtggcgactggtagagggagtactggtcctcgacgatgggcatgccatgatatatgtatagggtctttgggtgtgtaggtatgtaaggcgcgttggaaattaggttgtttgagagtttacgcgacgggggaaacggggctgtataacgtgacaggagggtgattgaggcggggggaaggggaaatccgattattttcgcctcttgtctagattttttctctctagtcgccaaaaaacaccctttttccacgtaaaaagccctccccgaatccctacgcgacacgactgtacaactctgtttcgaatagaattacgactctgcactagagggatgtgcaagtataacaggaatgagtgtggaggaaacacacataatattttggccaagacgagctcaatccaagcagacgggacattattatcggtctattgggcggtggtagttccatatggcgtgttccaagccctgtttccaaacccccttccccttttccccagatccccctccccttccccagatccccctctgttgtcccacagggtacgtacagtgtaccatctccccttcctacacctgtccatacatacagctcgtcaacacacgctctgtaattacatgactcccttccatcagcatctcattgtttctgcaatacagcatatagtgtttatacactgtacatatcatgtgtgtgtatgtattcttggaccccccgccaaccttacgcgtcgcgtatgagacagagtagacagtagaagggcaggaatagagacggctaccgactgttggataccgtcgaccacttccaagcgctcgtctcctctcgtctctttctcgtctttctcgtcttctcctcttgttctgtcctgtgttggattcgcctcaatatcaacttttcaacccgtcgcctccaaactccattcccacacactgtaccccttcaaggccatctccaacacctatttttgggttgcatattcatctattacgcttttttcttttcaaagcctcacgccaacgcccctgccaacccctgacgtcattcccgagcctcccactgtagccgcaccaccagtagaaacgtttcccaaacaggctctaaacattcccaaactggagtgtcggaatgcaccgagcccaaaaatggacattcctgaaatttacccctgaaaagaaacgctcaaaaaaaggggaataaatgcgaataaatagacaaaaaaggggaaatcggcagacccgaccgcctgtaattgattccacctcatgtcatggcgctagctgccctcgttcgccaacacaaagtgtccactccagacccgctcccaccgcattccacaacgcaatgcatagaatactcgtgtatgtaccaccgtggataaacaaaagacgttacgcagggtagagcggaagcgactttcccgtcagaatgcgagaatgtgcgctggtgacgtgcgcgggagggtgcgacaggtgtgacatgaccgtctgtttactccatagatataaggtgtgtatgtatgtacagggtgcagtcttgcgagagtgtgttggcaaaagaaaacatataaacaggggtaagagaacggtaactcgcactaaccatcgggagatgcagctgtgagaaggctctttttgtgtacagtacgagtacacaagtgtacttgaacttgtatcaccatgcatgcacttgttgcacattacagttggagacagtttatcatgttgtcatgtgtcacatctggacctgcctcatggatacacaatgcacggaagataccgatcaactgggacggcccaaacgaccagattctgaacgggagccagaagtagagccgtacttgggagtaccccttcctttacggactatcccatacgcttcagactccgacctgcgaggagaagcatctctgggtcttcgggagtgaggctccatgttggcagtattgatgtgtcgaacaatgtcctgtttaattctctgttcagaaatccgttcagagggagatcggcttctcggtctgcgactgtgtcggtcgtcccacctccgtagtcgttcggtcgactcgctgtggtctctgtatctctcctcggtctgtcgctttttctttcgtatgtcgaatcccttcttgtcggtttcctcagaccgacgcttctcccggcttctgtctcggggtctgtctcggggtctgtctcggggtctgtctctgtctctgtctctgtctctgtctctgtctctgtctcgtcggcgtcttctagacctccctggtgacctcgatccgtgtctgtctctgcagctcgcaccctgtctgggttcttcctcctcccatctcatttctccacacttgacgaccctgacactttccagaggcctgtagttgtcgtcaacaggtatatcgcccaaagctttgaggtactccaacgcagctggctccagcaggcgcccgaacacagtgttggaggtagacaagtgtgggtatccctctagtgtgatgaaccactggcacagatttcgccccttgtcattagaagccatgcacaggtatccgccctccgacaagtcgcaccagccgggactctcgatcggaaattcgccgtcgtcaaacacagatcggcccacgtctcctccttgaacaatgaactcgggagccaccaatctgtggatgtcactattcttgtatccatctggcgccgcacacaggccgacaaagttcttgcatgcctgtggagctcggtccgggaacaattcgagaaacagtcgttttctccccgccgggctttgcacgtccaggtatgctctcatgtgtgttgtagcgggcagtagttggaatattgctatcagagtttgtcaggcgtaatatttacatgcagaatatgactacatacatagcatcagacaatccacagagtgtttaaagatggtttaaaaagacgcatttggcggtccatgttgctgttcagagcccgtttcatgtcattttccatctctggaccgtttctagtccctttttgagcgcctggctcagcccatgtttccaaccaaattaccaagtaaacggccttgtatacttgactcgattacttactgtatctcaaggttacagtaggtttcgatcgaccgtttctatttagacgctcattttccgtaattcaaattaaggagaattctgggaactactgtagaacgcgcagcgacgatcgctcaccccggatctgcattgtagaaaaaaagagcgagctgtgcatatcatacacggcctgtcgcggtagacgtgttcagcgcggaacaagaatcgcgagaccccgtgctcagtgtctgcaaccacgggatgagatggatgacatgtctttcgtctgataccccactttctcgtcagaccacacgccctccaccaagctccatattcgtataccgcactaagtacgatacgagcaccgataccgtatcaatagtgtcgctcccattcaccatactcctgtgtaatatccattcaccatactcctgtgtaatatccattcaccattctcctgtgtaatatccattcaccattctcctgtgtaacgtccattctgacgatatccctcgttcaaccacccacggtcaatctcacactgtgcacactcaccgctcgatctgagatcgcagcttccagaacaaagaagccccccttttttttctctccttcatcgctaaacctcagccctgggtccttgtctggaggatacgtctcgtctgtcttcctgtccttagggcatgtttcagctcgcgtattttagactcccgccgttccaacgaagcacactaatcgggctttagcacgcagtgcattcttccctttgtttggggtaacgatacctaccaccggccccgaaggaacgttcagggccatggtccacttttagccccttggtacgccccagctgcaccttagagaatgtgcagggctgactcgaacctggtcggtacgcggcgtgtcgtgcaagatggatggcgcgtatagttcatcggtcgaatatcagatgcgagcgacaatgggtaggcgaagagtgtgacagaacctcagacagacgacagtctggggtcgcaggtgtgagacagtcttgtagctacaagtagcactggtgtctcgcaccgatcggttgcattctgtctcagccaaaggggtaacttccaaccttggttgtgtttcagcccgtgatggagtcattgcactgtgggaatgcagggccaggaacctactggttgagagttcgcaggactgccaaggtcaggcgcgttggtcgtgtcgggtgagacagcacgttgggcaaaaaaaaggcgagcaggcgtgctgtgtcatcttcgcgatcaacagtaacgaactcggtacccaccgctgaatcactcgaccatcattctaaggtgagattcatagtaatggtatgagctctactaaagcgccaggatgaacatgaactgctcaccttcggaaaagtcactcggtcaaaaaaaaaatgaaaaaagccgaattcgactctgccttcgaccagatttgaactgatgatctcagcattactagtgctgcgccttaccacttggccacgaaggcggcgattgcatttgtcagggcccggtttgagtgtatctagactctcatcagaatttgaaccttaattgatgttgaatttggacgcgtgaccgtgtcgggacgtggttgaaatactgtataaataggaggtcttctagaacagtgtgaatacgtacgccgacacccagacaatggcagtgagaccggataaaccgacatacaggccggataaatctaatgccacaatgagaccgtcgacgaccgtcacagaatgctcatgtcatctgagaggcaacttgcacatctatcctgtatcaatcgtggagcgtgtaaaacgtctctgttgtgatcaacatggtctgctcgtgtcattgacctagtagctgtccacattgtctgcttcgttgggattgcatgtccattgtctggaggtcggagatggtgtacgtggatcctcggcgtcttttcttttttcttctggtgctcttcacgacctggtcgctatgtctttgttttctgcgggccggggaatgatcccacctgctcacgtcacgtgaatggtagtcctgtgttcatgtcacgtgactatctgggccgtgttcacgtcacgtggctctgtggtcaacccagcaaatctccatcatgcactgtatttcttgtagtaaggcacacataccgtgtacctgtagtccggcttccaagcagggcagtgcggattgtctctaacaagggatttcgcgacatgtattggtggcgaaattgtcatcaataggctacagcacgcgtcactgtggtctcatacagggcacgtctcatctgcaacagatcgtcatcggtgcatgcaagtaagggtgatggggggataggtgttggcgacgtgttcgagggatagtagatgtggttggtgatgtggtcgattcttcatgtgatgcgagagcaataattacggatactcgtacgaatacttcttcgaggatcctatactcggtccaattagaacccacaagaacagtacagtatgtatatgtacccacagttttgatattggatggagtacttgtagaatgcggtttcagagaacggtccgcccaagccagaacatacaactactacaagtagcaccgacccacccaccaaaaaacatcttgtgctggatctccaataccttttggtgaatagtcccaaggtcttgctgtcagatcatcagaacgggtccgtaaatggcttcaaactgcgaaatccgacattataacgagaaaatagtcataattagtacaaaaaaaagcaatcacactactgtttttcaaaagcccccggttttcgcatgttttctcttttttttattctaatgattcattacatttttttccctgaaattaatctttacgttcttattgaaaaatcaggattcacaaatatgtaacggatcggtgatgggtcaatcctcaagatatccctaggtacgagcggtaaccgctcgtcctacgctacagaacagtacaccagaacagtacaccaatagtacgagctccggaagtcgtataaacataacttaacttacatacttgtgagtggtggctatatatacaggcatctcaaccctaactctgtaaagcacgtcactatccacgtgacctagccacgcgataccaagtattcatccataatgacacactcatgacgtccggaggacgtcatcatcatccagtcacgtgccaaggcacatgactaatcataacaccttatgactagcttctgaatcgttacaaaataacatttaccagaggacgtggcgtaatggtagcgcattggatttcggttcttctgaacgacgtcctccaaaggctgcgggttcgagtcctgtcgtcctctctttttgcccctactttgcgtgataactcgagatatcaacggtatcacagcaaagactttctttgtttttttgtctctccaagaacataatctgcaccgctactttagcgccatccacaagtgcgccgactacacaacaatggccgcccaaacacggatcgacaccaaacctgcgatagccatgttttgacgccgggctcgtgaccaaaggcaaaaaccacattcctggcaaataatacgagctccaagatttgcaatcgataagagtcttacagtatgtactactgtggtcatgtgagaggtcttcccatcagtcagcagtcagctacatgtccacagtagaaggcgacatgctacagtaggagtcgagaaacattgtcatatcgtctctaatactccggcagctccaaaactacagaatgggcgagtcgccgatagtgggctcgtcatgaccggtgggctcgtcatgaccgatagtgggctcctatctctttattaaagacaatcggctgtacagtttgttccttgtcgatcaccattttccaactacacggagccatgtactaaaagacatgtttgagctgggtttgatttaacaatcataagacaagccattagaagctgctcatatagtacaaatactgataccatatgacacaataccgcccaggctgccgttatagtcccatgatccgtcgaccaactgagacaacagccgtccatggttgcattgaaggaatgtgaacctagataacggcggtttcgcacggagtaaacaccaaaaagtcgcggcgatacacacactgattgcgccactcttatcttgtgtccacataacaactatataagtcccctttaccttaccctcagcttctcttctcttctcatctcagatcatctcctccgactctctacactcgttcaaccctacccaacccttccacaatgcagttctccatcgtcctccttgccgctgccgccggcctcgtttctgccggtaacgccactgccgtcgtcacccaaattggtgatggccagattcaagctcccccttctgccgcccctgtccaggccaacggagctgctgccctcggtgtctctgccgccgccgccggcgttgttgctgccgcagccatgctcatctaacttattaattaattatttccaagtcccagaccgtaaggtgcaagtaaaagtaggactggtgtcgttatgaggtgagtatgagtatgtcgctgttctccgtccgcgtcggctggctacagagttcgagcagatatacgatagtataatgtatataatcgcgattacatcaacccttgcctacaacacggtatgtactgtgtacttgtattgtagctggaccaccgactatctacgctccaatctaaagacgtgaacgtttcgacatggtccgagagttcttgtctgtctcgtcaggatggtcgtactgttggacggggtactgtcataccccgccccatgcggccaatagcgacatgttggcacgaatttccgcagtatttagcggcatatgccgttccccagctcgatggtgggccacaagcttccgtgtgtcgaaagcgggcctccgccacggctctcggtggattctttgggtctcgcagggtgtatgcctgcgaacgagacataccacgataggtggactgccatgatacgaggtaatttctcgtacatcatgggcttttgccaggccgtaacaaaggctggacttgtttaaccacaaacttgtgtggtgggaccgcacgtttgttgtatcgatgaagaggaaaagagacaggaggttgggaaaggcgggttttaattctttcaataactggctgaaagaagtagctacttgtatcataagaaacacttggccgaaattcctatcattacgcacgtcaggtacttttcatcatttcttggactacaaacacaatgatggtgcttttctggttggctctcagtcatttcctcagatgagaatgatatcattgacgaagactagactggccgggaagttatttacccaggtattgtaggtaatgtaccctggtctgtctgtcgctctagttgtcaactggtctaagtgaagcctctgtgtgtaggcatctacggtctgtatgtaaccatcaactggtgctcatctatacagtccctcctatccacccttatagcagttagtagactgtgctacacccagcagttccttgtacaagggctatctacgcttgtactttgctttttagacagcgggctgacctggtttctggattgagtactgcgacacgtcttgtgtttacgaggtcctgtcagaaaaggaggtccatcgatacctgggaccgccgacgaccttccatcggtgctcttaccgacaacgatgaagagaacttcaaaatcttcaaatcgcgttgcgaaccatgtgtgtgtctgtcggggactcctaccgagctcagacattgaattggtacactgtcatgttcagatactgctgaattgagccacagaatctcactacctaaggagcccttgccttcatgacaatgtaacgggggctttacacgcaataagagcattgacctgagccatagagccagagtatagccaatgagctacgtgagccataagtccaaagagcaaggtggccacacaggtcagagccggcgctgatgtgccagagccagaacccatgccacgagcaaagagccggtaagcccttcaaggcaataagtgccaaacgctgtgagagcaaggtcaatgccactaagtccttcaatgcgataagggcatggtcgccattcgagccacgaagtccagagagcaataagagccatttcgcctgagcaagagccatgagtccacagatgcaataagcgccaaacgtcagagcacaaacagagccgaaggagccagggccttagagccgagaccagccagttgccaataagtccaaagagcaatgagagcctgagcacgagccgaagtcacactattcaaggagtaggcggtgaacctcttggccagaggaagtaactgaccgaatctgtttatctagttttgagaggagtaggtgaaaatccgaacctcttgggttagtaaatcattgaccaaagagtcccctcgaatatttgagttgtagagagttgaacagtatttgtatttgtagagaagcttgatcttctgtagagaaccattgctgaaccgccttgatctcgtgattattcaccgagttagagcatggtattgatagccagtacacagttccacgtactttctcaacggagaggccaaggatcagtagtgcggaggacacttagcctcgaccaatatccgtgactcccttgttcagagcaatcagactgaccccactagactgcctgtgctaggattgaatgctcttattgacttcgagcacgacaccattggcctcacgttcatatgtcctcctttaagacccctgtgacgctctcaacgtgtcaatcaagacggcacaatatcgccaatcggggggggggggacacttattgtgccaggtgccacctcattcagaggtcataaaacagctggagatgatggcgatagaccaagatatacttttcgttagagagactttacacggcatgggtttttgacattacaactacgattagcatcttaacaatctctcgagaataacataaaataatatatggaagtcatccaaggaaatattttccacaatacatccaatcctagtgtaataaaccaacctgtggccaatccaacaatggttccagaataaccaccccgcaaacacaccctctataatatcataccaaccttatctttgcactttctcaacccacctttttctgacagcccaaaacatcaccaccactttgtaccagtgctgtgctgtatatactgtgctgtatgtactgtatgcactgcaagcaacctgatacctctgttatacccaatcacatgaactctttgtacgtgtaaacgaaatcatgtgaagatggatctcttgggaactaccctcaagaatgccattctacctacctaccctcaacgcgacggtacgaagcaaggaaacttttccaacacttattccaccgcttgagaagacaaaagtgttatttagcaagttttacaaccgtctgcgtgactctcccggttcatcttggctgatttgcagtgttgatgatcggcaaaagtaggtcctttgtgctattattccagaggtggagaggcagtttcaagacaagtatcacaccgagttgatggaagagaccagttttggtgatcaagtttctacatgctccctacctcagtttggtgtggactcacttgctccgttcttacctgtgcaatatgacccctccaagtacatgggcatctttcatgctcgtatgattgtggtggtgactcagccagttcataagattgctcagggcgcgtcgttacagaataggtttgttcccatgctgtccgtggtgattgataagcagctagatcaagctgataagccgagatatctgccaggcagaagggcagccaaaagaagagtggagtttcaggagggatgtatgagccaaagaacagtgtttacagatccaagtcgactctgtgagctattacgtgggagtttggaacatgcaccaggcaagcacataggtgaagagctgctgagagtaggagggatatatgctcagtctggaggggacaaacaagaaaagagtgtgtcaaagaagtttgatcatagcgagtactcagggatattatggagggataagagatgataacggggatggagtcactagacgtcaacgaggaacattttgagtattggactgaggtatttggactactgaatgaagatactgagtgcccagaaggaccccctttttgatgtgaagaagactgtgacgtgagctgcagtgtatttaagtcgcattgaagatgatgtgttcttgctgagactcagtattattgctgaggttacgtcggtacattacagccatctctgttctgttagagatgtgagagtctgctctccgaggcgagtgttcctgtcactgggactgttgaagactagtaaccgtggttgtcggtgttgatccatcagctgcgacgttggaggtattttgcccgggttggtgtcgttggctgtgattgttctctagacatgagatgttcaaactgcttgggtatgttctcggttgctgagagctggtcatttctattcatgcactagttgagagttacttgtagttcttactttttcacggaagtctctgaatgttaggctgactttagtcagggcttctgattaccgtcaagcgctccacattgaggatggcggtgttgcttgttccaagtgtgctatctatggtagttgtcgctgacagtctcgtcacggtaaactcacgaggttgatgagtcggtttccagtctcgctctatggtactctgtatattggatgcctgtgcctcagtttgtgattactgttgttcagggagatgcttgtcttggacatctcgacattgaatcgtggtgcttttatcgtataagatggaagtcgcgccacgacttcatctaaggggaggatgatgttagggatcaacggctaagaaatggccgcctgattagtagtcacccgtgaaccgatagcggagttccgtcgggaccccgcggagactacgatgagaggccaccacgttggctctcagtggaaccacgctatcattaatatcgatatgcaccgacaagggttacggcgcaactctagataacataaactcctgtattccatgtattctaacaatttttttctttcctttttttttttctttttttcattctgctgattcactttggtcaccgcggctgagtcatcaatctgcttagtcatgagtccttgttctagcttttttgatgtaacgattcagaagctagtcataaggtgttatgattagtcatgtgccttggcacgtgactggacgatgatgacgtccggaggacgtcatgagtgtgtcattatggatgaatacttggtatcgcgtggctaggtcacgtggatagtgacgtgctttacagagttagggttgagatgcctgtatatatagccaccactcacaagtatgtaagttaagttatgtttatacgacttccggagctcgtactattggtgtactgttctgtagagtaggacgagcggttcccgctcgtacctagggatatcttgaggattgacccatcaccgatccgttacatttgaacattccggtcccttggcccagttggttaaggcgtcgtgctaataagaaattagcctctttgcaacgcgaagatcagcagttcgatcctgctagggaccattgtttttatcccatgggacgagatatggatatggagtctcattttggttatggcaccgtcatcgctggtgtttcactagcgtattgtgtctacagtagtgtttttttatacatatttttttatagtccctacaaacaaactcaagtatgcgccaagtatgcgagataagaacctaaagtgctgaacaaaaaagctgtaaaaaaaaaaaacgtacgaaatcacaaatctactgaataccattgtaccgataagtggaatactgctctgttatagaaatacgctgaacaatccacgtattacgtaccacatgtccgtatgtactttatgtactggaaattcggtactaggtctgtacttacgatgactatctttgtcgttctttgctgaccgcttctttcgactctgggtggacctgggatactttgtaaaatgtctgagacttccaaaatcgatcatttgccttctaaagtcgtcaggattcgatgtcatggtgtctctcagtctggataagtcatggtcgtggagagggtatggaaaagattgggattgagtcctgcaccaaatggccgggcttgggcaaccagaagatagaccagacatataactctacaattcacacctctggttttcatttccccatcccatgtaaaaaaggacagacataaatgaactgagagatcctccccgagacgatgcggttggagtaagaaatgcacaatggagaaccaggatcctttcgatgatactcgagactatgaggataagtccaagctgaggttctacagcaacgaatagcacgagcttggcacagttggtttgaactgtccgctgactttcaagagcgttgacgctttcacagattaccaagtcatgttctggtagatcaaggaccgccctagcagtaacgtggatcaagtgaacgcgcaaaaggaccacaaacggaaaagaacagtttgaccagggtctgtatatggcatttactaccattaataggtgtagttcttcggtgcaagtaatgtgggctcataaactaggaagttatatatacacgacatccctgatcccaccattgatacaccgatctaagcaggttacaaggtgccacgatctgactaggaggttctagataccgtctacagctcagatgtagcctgatatacatgctgaatacttccaaaggtgagagttacgtatttttagagatatgttcagttaatagttttgtctcgaatgaggcgggtccacaagcacacagatgccaatctcatctagagaccagagccgttgtaagccagcttgttgggggtaccattgaggttaccggtgattttgccattattggcgttgatgagcgtgtcctccacttgggcaggggtcagaagctcggacgaggtagccatgagttgggcagccaggccagccacgtggggcgtggccatggatgttccagagttggaaagaataccgtcgtcggactggtagtcagccgaaagaatgttggttccgggtgcaatcacatcaacacaagaaccccagttggaggccttgttttgagaagggtcccagatggcgagagagtcgtcggaagaggaggcagcaacggtaatgaagccggaggtctggctaccggctcgaccgggggaaattccacaggcatcggtgttgtcgtttccagcggccacagcaacaaccatacccttctccacagcctttcggaaaagcgcgtcttcagcctcggaagtatctcctccaccagaaaagttgatgacggctcgggggtacttgtccttgttcttgacgtagtcgtcaatggcccaggagacgccctgcatgatctgagaagtggagccgtacatgttggcaaagaccttgacggaaatcagcttggtggagggagagactccatagccagctcctccaatggtaccggccacgtgagttccgtgtccggcgttgtcgacattctggttatctgcaaagttggcgccccaggaggctcgaccctcaaacatcttgtgggatgttcggattccggagtccacaatgtacgccacggtggggttcttggtgtccttgttcatggcatactggttctgggactgcgagttctgcttgtgagacactcggaacagaccccagttcttggtggggacctcctgaaagttgccagttccgggagaagagccgttggaaggtgcgcttgagggggcggtggaaggggctgtgacaggatcttcaggagcaggcttagaaggtgagggctggttggatgggaacggattctcaccgccaattgggggaggaaactgaccgatagggttgggctggttgccgatgggttgaacagcgtcatcttcaggctgctggccttggccgttgttgggatcctggaccggactgtttccctgtctccaccacttgaagaagttgtcaatgaggccttggtaggcatcaggtgtaccctggtacacgttctgggtggacttgaagctctcaaaggtggggagtttctggattcggtctttttcaaccgtcaccaggtccgagtaatttcccagagtatcaacaatgctcttgtcaaagtggcctgtgtagcccatgaggccagagccgtccttctgagagggcaagtcaaaggcggtcttgataccgttgagagagtccttgttgatcaagccgtccagcagcttgaggtgttcagaaatctggtcaatggacacgccatccttgaagacaatgttgaaggagtcgggttcctggccgtgtcgctttcgcagactggagtcgctgaacttggacgactggccgttgatgatatcaagagcgtccttgtaggctccctgaggagccatgggagcggccagacaggccacggccaaagacagaatgactgagggtttcatggggggagtgaaggagtgactgaggtgggagagatgttactatctggtggattgaagcagaatccaggtcgtttatgtatccccagaactcatcgccgctcgctaatgcactcattgtattgcacttcatgcgtgtagttacaggtgcatccatgtctgtgatgtgagacttgcgtgtgcctgccaagccaggggcgcgggagtgttagagcgggaatggaggttgagataagatggcagatcagatgttgaccgtggtttgggtgtccacaatctctagatactgtagtgcacttgcccaagtgtacttggtccaaaagacagtacaaaagatgtatttgaagctatcaaacacttgaaatttctaacgcttcaattaacaaagagatttgcaattgaacacccgctcgccccgccagtctgaacatcaacttcaaacgccgtgcctggatacaaaagacaaaagtgcatgcacccctgcatttctgaaactcggctgaggggttgcattagtccgatgagatgcggccaattgatgatatatgtgccgagaaacaataccgacagcaaattttatctgatttatcaaccagtttctcattctcgccaaaaaaattcgcctttatacccccttcccacctcattattcctgtttgctttttcccgcctagtgtttcatgtttatgcattcccggagtgtgagacgaggacggataaacactaatataatcgtttgtgacggagtagatcagtggggtagatgattacgatccgtatacgacacttcggcgcattctgctgctttggaccccccccagtgccgtgtttctgcccgcaccgaccatgttgcagtagtcgtacttgtaagaggtaaggctcaggcaacaaaccgtttcatgatacccgcctgctttaacacaatgttttagcagcagttgctttttaccacaaaagaaaatgtgcgtccaaggggatgtttcgtgtgcgttgagacagcctgtaattgagatgccgttgctaccgtgagacacccgtggtcaacgcgtttggtatccattagtggaatgaaatacaactaacagtatatagtgaacggtaggattctggaaaaaaggaagtggcagtaataaagtccccaaactggtcacttttctagcatgtaccggttcatgccaagactgtagacacggcacagcaacagacaataggtctgatgttctccattgtccagatctcctgtttcggccaagaaagaacttgtaccatacaatgaggcaatagttgctacggaaaggtacgcagccagaaagagatgcgtatttgagaccacaagtgtcgagaacggaagcgttcaactcgtaacaggaatgtgactcccgtgtgttttaggaagtgaaacaaatgtcgacgacttcgtgaaacacaatcaaataactgatgctataacttgtacttgtatccaagctggttatggactctttgtctaacttgagacaattccaacgctctttcaaaactcttagtctacgtttggattgacgaacaggatatatatggtgcaagctacgaagagcaaagaattgaccaaaaggacacctcgggtagttcctccaatcgtctaggcaaatcgagttgtggcattgccatcttatctcctcattagccaacccttttctgtgctcactatgcaatgctcaccaagtacatggtacagtacataccacgaatggaagagttggtacggaaagggtgtctggtacaggaatgttccacatgagattacctaaaatggcaggtgaaaatgtgttcctttccatggattgagcaaatgataggtattatgacttcctgagatccagtatggtacggtaacataacttcctgaggttcgcttcatctggtacagtacggtacaatgtaccagagacactcgtttgcttcatctcttgcaccaatacccactcttgtcaataacttattattaagcagctacttacgcatgtcttgtgcactacagctcatctctaacaggagcctcagtcgtcccagaagtatcagtctcatgctcctgttcactcacaagctcttcggccagaccagcaacctccttggccagacccagaagctcctcggcgtgctctcccttgacttccacgtgatcatcgtccaccttgacggtgtagggttcttctggcgcagcagagtcaggatcagcagcttcagcacctccgggaacactctcatcaccaccatcagccttcttggcctcctcctccttggccttcttggtctctctctccaatctccttcgctcgtcttcctcctctcgttccttctggtatcgggcgtctgtttcgggggtgcccttgacgtcatactggccactgaatgagatcacggtcgacttgtcgggattgtagatggtggcgagcacaaagtagcgggacgaagggatccagtcggggatgctgaccgttcgcttgaatcggatatctttcttggtgggcttcaacggacaccctcggccaatcttgtgctgtttcattagatcacacaaaggatggatgcctctgtgcacctcccggaatcccgagtagacggacacgttgagataggcaccgtcctggacaaggtggttgactttacccacaacctcgaactcgacatcctggcccgcaggcagagggtaagccgaggcatccagagcggtgatgttgatggcctggggctcgggtcggtcgcacacaaggaacttgacgttgccgggcaccgcgtggcagtttttgggcaccatattgtcgagacccagaaacttggcgagaatgaactcgatgttggagtctgcggccagcgccgaggctgccatacagacggcagatgcgatgctgaggagtttcataatgtcgtgggatgtcgatcgatcgtgcaccaaggatggtatatgtacaagtagcaagcacggtcccccgaggcctgttccatggtgcgtcaattaggctttttttcagacatgtgtaacactcgctctggagagttagtcatccgacagggtaactctaatctcccaacaccttattaactctgcgtaactgtaactcttcttgcgacgtcgatcttactcaattttcctgctcatcatctgctggattgttgtctatcgtctggctctaatacatttattgtttattgcccaaacaactttcattgcacgtaagtgaattgttttataacagcgttcgccaattgctgcgccatcgtcgtccggctgtcctaccgttaggggtagtgtgtctcacactaccgaggttactagagttgggaaagcgatactgcctcggacacaccacctgggtcttacgactgcagagagaatcggcgttacctctctcacaaagcccttcagtaccgccgcctgtcgggaaccgcgttcaggtggaacaggaccacctcccttgcacttcttggtatatcagtataggctgatgtattcatagtggggtttttcataataaatttactaacggcaggcaacattcactcggcttaaacgcaaaacggaccgtcttgatatcttctgacgcattgaccaccgagaaatagtgttagttaccgggtgagttattgttcttctacacaggcgacgcccatcgtctagagttgatgtactaactcagatttcactacctaccctatccctggtacgcacaaagcactttattttctcacatctggtggacgacacctcgtttttgtttcgagtgatagcctgccagatttattgtgcctttactgtcgtaccagcgtattttacttccctttccgttctttcgttttcaccatgtcgaaagtaacaaaagacgagttccaggctctcaccgcgaagatggacgccttgacgctctcccaccaggagatcaccactactctcgctaccgcggttaataccaaggaattccgctcagccttagacgagctcaagcagtcaaatgagtctttcaagacacatcaggctggggagtttgaaaagttgcaccagttggtgtcggcccagcacgaaaccatcgcgaacctcagcaagcgtgtcgactcacccccgagcaccagctcccttgaaggcatttcccgtattggcaaggctgattccgaatttgaacccgacaccccccagaagggtaactctgtcctacatggcatggactttgctgccagtgacacgggttctgttgactatcgaaaagaatccgacgccctcaagtccatcatccggaacgaggtttacccctccttgtccagcgaagaattccgaaaacagttgtacgcttacaaatcttttgattcccgggtggctacctttatcctactccaggatgacatccgttggagcaccagagctcgggctttccacctttggtgcggtgtcaacgataagcagcccctcttcgatcaacagtacctccaactccgaagcacctttgaagcagagactgctgatgaatcaaccaagccaggtgcccacgctcgtctgaacaccgcttgcgaacgtctcctccgggacctttttcgaaagcgcgggtttgaccacgaacctgctgtctcctttgctgaacaagaggaggaactccgtttccggttcaaagattaccacaccgctttctctatcgagacactacgtgcgtacctctctgctctgagcaccgctctgacctcctcacctctgccggttctctctcggtgtctccagttgcagaagctcgctccgactcacctgggcaccgccctcggacgcgagatccctcgtgacaacactcgttggctgagccttggcatggactccgaccctgagcgtgaccatcaagttgccacggagctcatccagcccctcgccaagatgatcacccaacatgtccaacgacttgacgatctcaatgatgaggctcttctgagatggcgacagcacacggtatctttcgaagacgtgtggatgtgggtcgagccttccgccccacctgagccttccacgcctgaacctgacaaagtcgtcgttcacgttgcgggacgtggtcgttccaccaggaagcctgccgacggccctgtctcaactgagactgtgcagaaacccacaatccgtgcctcggatgcctcaacctcctgggcagctgacaaggctccttgtgttttctgtggttccactgcccatgcactggtcaactgcgatgactccgaaggcagccccttggtcaaggccaagtaccttggcagcttcaagtctttcacccgacttggctaccagggttttgaaaagtatctatcgcctgttgatgctgacttccctctaaaacagagcgctctctacacttcctggaagcagaaggaatggtcgaatccgcttatggagcctagacttcgaactttcaatgcgcagtggcgtcctgccctagctggccgcgtaaatgccgttgaatttgtacacgttgaagacccaggcgggcctttggataacagctatgactctgactcatctgcgtctggttatgacttccaggaccttctccaacccggcacgttcagtgtctgtctaggaggggtgcctcgagatcttctgtctgatacgttttcctcctacgacgagcctcgcactatcattgactccactgactcccagcttgagctcacgaaagaggcaatccaccagcacattctccagatggcaaaacagcccacacccctccccgtcacttacgcaattgatgcgcctgtgtcaggctcctacagtggcaacatgaagcgccttgtggcacacccagccttcatgcagctcgtagctcgcttaactgctcccccgggcacgttcaaagcctccacgcttgaagcgggttttgtaggtgctgttatggccccgtcttccccagttgccggccgtgtctactttgttgatgcggtccagcgattgctcaacaagtacaacgtagtattgcctacgaagctttacgagtgtttcgctacagtccgaaatgacctcatggagcccgcttacgccaccgaaggcgatcctcgccgacagtctctcaagaccaacatcaacgccttgaaaactgttgtcgacagcaagcaccctgacagaccagtggctccgttgccgcgacgcagcccccgtcgtgatgtccgtgaagacatgcccccgcctgctttgcctcaagcgacaaaacgtggtgccgcttcttctacggtatcttccgctgctccccccactgctaagcgaaccaaggctgtagccaatccctcctcagtggggccgactgactccgcatcctccacgggcgctgttgttgacgtccccagctctcgtgtggctgttcaccccccccgtctgggtgataaccactacgtgagccctggaacccgtgtcaccaaccacatccacgatgcctctgccgttgcggagaatgcacccttaaaagattacaaggatgctctggaccgcctcccgtctgacctagaggactccaaggctctcttcaccagagatcatcctcgttacgacaatgccttgctgaaggctgggcgtctccctctcttcaagcttgaggccattcatgctctgccggaatcggaaaaagcagacttgtttgagcgcatcctcaaggcgtcggatgttgatggcctcgttctttttgagcttctccaggtgtgccctgacctcacaaagtacatttggaagaacttccgtcaccagcggcaccggcttgcgggtcctgacatccaagccatcgctcttgagctcggggacgatctcatggagtgtgccatggatcttgcgctcaacgtgatttcgtccacaccgtatgagctcaactctggcaccttcggtcgtcttcaggaggttttcaccaccattgaccgtcagctgtacgacgacaaagttggtaggccactctcgccccacttcaccgacaacattgctcttttcgaccaacagaccagcgccctttttgacagtggctcgtctaacaacgtcatcgacactgatttctttgcccttgtactcgcgaaggctggtgtcacccctgaccgggtgattgttttttctgacggacagtcccacgccacagtcgcaaacggagccaaggtaaaagttgatttctgggcgcttctccctgtcactttcctgggtgtcgttactcttgaaacattttgtgtcatgaagtgcagcatgaagtgtattctcggcaccggatacatcagcaaactgcgcatttcgttcgaccatgatcgttaccgtgtcgcttcagtggagaaccctggtaaccctggcgtccggtgctaccctagtgacagaccttcagctggccttgttgctcaccttgggttgcttgaccgtcttgtgaggcccggccgccggcctgtgcctgcgtttcctgctgccaagctgtctcgccaaaacgtcatggcacacgttcgacccactccctcactctgtggtgatgttgatgaagcaacaaatctccttgacgcctcatctctcggagggcctcagcctggatcttactcccaccgttctgaaacagcggcaggctgttttgccatatcctttgctgatgactgtgagtctgccggcccgccttcgagcgctgccaccgccattctcaaggctctagcgtccagctccggccctgatccccttggcattccccctcgtgatgaccctgacgagtcttactcctcatcacctgggcaccacggtgatgtctctggcgagcccaactcctcatcacctgggcacacctccgctcccgtcgacggtacgcttggacctttactgcctaccgatgcctcatctgtggatgactccaacgagctctgctcctcctcttcaggctcggaagccccgtcggaagccccgtccggagtctcggccgccttgtcagatgtaggcaccgttttccaggagagctacacgtcgtaccgtttccatgacaaccttgcagacaatgctcttcatgccagaccccccgacgctcatgctctcagtggttttatttcttctgccgacctcgacagtgttttccagtatccacctcctgcatcgccctgcagctgctgccagcagcctgtacgtgagtgtcgtgtacttggtaacactgttttcatcatggctgacattggcgactcggctaccatcgttcaggttcaaccggatactgacctgtccatgcgccaacagctctaccttgctgaagttctcagtgatgcccaagaaatcacccctgaagactctctgcattctttatctgtctccgtcaatgccatgtacaagccgctacacaagcgttctctgcctctaaataagcttcgcccggacggttcctttcctgtcggtgacggctccaagccttctccgcgacatcgcaacttctctggcgacgagtcttgccaatttgatgccaaacttgctccagtccttttcccggccgagcttgctctctgtcgccatcgcatgtcggacatggagggtgtctgggctttcaacgaagaccaggagggtgtcctcagtcaccatattgaggagcccaccaagatctacgtggaagagggaggcgttatcaactcaaagcacttccctctccgcggggctatggtcggcgctgccaaagacatcatcatgaagggtctcgccaacggccagatggagcccagctcctccccccaccgcaacgcctggttcctcgtgagcaaaaagagctcgggataccgtttcatccttgactgccagggcctcaacaagatcaccttgagagatgctttccacccacccaacgcggacctcctggctgagagtttctgtggtcgtgctgtaacttccctgcttgacattaagaatggttacggtcagaaggagattgctcccgagtcccgtgacttgacggcttttaacacagattttggctcctatcggttaacgcgcctgcctcaaggttggtgcaactctccagcggtgttccaccgtgccatgctgcgcgtacttgggcccctctttccggatcaggctgttgttttcttggacgatattggcgttctcgggcctaagactgactatggcggagccatgcatgacgactttccgggctgccgccggtacatcgtcgaacacatggacaacctcatggctgtgcttcagaatctctatgaagcgggtctgactgtgtctttcgacaaggccgagcttttcgtcagtgaggctgagttcctcggtttcctcactacctctgaaggccgcttcccgtcccctggcagttccgagaagatcgaatctttcgagttccccactactgtccgtggtgtgcgctcttttctcggtgctgtggtgtattttcgcatgtggatccctcatttcagcagtatcgctgcacctctgtacgactgcatctccgctgcgcagaaggctggcaaactcaagatcaccaagaccgaggccaccgagtctgcttttatggcgctaaaaaaggctatggtgagccctgcggttctgcaccgctacgaccccaccttacctattgtcatcaccactgatgcgtcctccctcggatggggcgcagtaatgtctcacatcgtcagtgttggccctccggctgcccgtcgccccgtccgtttcgagagtggtttgtggaaccccactgagcgtacctacgcatccaccaagactgagtgccttgctgtaaaacgtgccttggagaagtgccgtcactatgtcactggcgttcatttcgtgatcgaaactgacaaccaggccctggttttcctactgcagcaatcccgagttgaactccctaacgctatgttcacccggtggtttgcttacatcaaacagtttgattacgaggttcgatttgttaaaggccgagacaatccagtggccgattggctgagtcgtgagaaattttctgacttccgacctgtcgattttcgccctcctgttgctgatacagctcgacaagctgatgagcttgctccgcttgtgcccccgacttggtcccctgtggcctccatcactgtcctgtccattggtccagagcccgttttcatccacaaaggcatctctctcgatctcattttcaccaccattgcctccggcgatcttgatcgagatggtgttgacattccgcctagactgcgtcaaatctgctctgagttcttcatttttgacgacattctcctactgatcagctcacctggtctccatcgacgtgttctcttcacagagaaggaggtgtctgaggttctccgagctacccatgaacaatatggccaccgcggtgctgctgccatccttcatgctctccgtcgcctctattactggccgggcatggctgatcacgtgaagtcccatcgtgcatcatgcggcacgtgtgcaaaagccaccaaccatggtcttctcaaggcgagtctccacttcgtggttccccgtctcatttgggagacagtccagctggacatcctctaccttcccgctgttcatggtcccaccaaggagtaccccgatctggctgatcccgccaaggctctcgctgctcaaaccaccctcaccgacttcctccccactgcccctcagttcactgatgtttcctctgccccccgcggacggctaaatgtcactattgccccctaccagtatgtccttgtcgctcgtgatgaattctctggctggcctgaggcggtgcccttacgaagtatcaactctctctccacagccgctttcttctacgatttcatcattgctcgttttggcgttccccgtcgggtctacactgacggtggtagtgagttcaagggtgattttaagcatctctgcgaagatttccacatcaagcaggttttcaccactcctgctcatggtcaatcgactggcattgtggaacgcggtcaccaaaacctcctccactgcctgcgcaaatacggtcgtcagtggatcttatacctccacaccgccctctgggctgaccggtgcacccgtcgttcatccacgggtaagtcaccttttgagctgatgtatggtgtctctggtgtcttgcctgtcgaaagtcgtttcctgacctggaattacctcagtggcaagaccgacctggcccacaacgaccccgctcatgctgcttttctgcgcaccttgcaacttgctgcttctactttcgaagttggctctgctcgtgaccacctgaccctgcaacgccagcgtcaaaaggcgttctacgacaaacatcacaacacagctgatacagatcccttggccgtaaatgatttcgtttttgttcacgacctccgtccccacaacaagctgactcctcgttggactggtccctccatcgtgaccgcgtgtcaccctgagaccagcacgtacactgtcaacgatgttgacggtgagaacccgcggcgtatccaccgcaaccgcctcaaggttttccaccccgcttccatcgttgagttccaggaccgcatgaaggaacatcagtcccgcgagtctgctctccctgccattcctggccgcttttctgcctgttctccacatgttcttcccccggcttcagtggctactcgttccgtccgttctgcagctaccactgcgtcgactagagttacttctcggtcgaagctcgctcgtgttgattctgggcttgctcagggctccttccttgctcagggcctttattcttgattcttctaaccagggcttcgggacgaaaccccgttagacctgggcaggtgtaacactcgctctggagagttagtcatccgacagggtaactctaatctcccaacaccttattaactctgcgtaactgtaactcttcttgcgacgtcgatcttactcaattttcctgctcatcatctgctggattgttgtctatcgtctggctctaatacatttattgtttattgcccaaacaactttcattgcacgtaagtgaattgttttataacagcgttcgccaattgctgcgccatcgtcgtccggctgtcctaccgttaggggtagtgtgtctcacactaccgaggttactagagttgggaaagcgatactgcctcggacacaccacctgggtcttacgactgcagagagaatcggcgttacctctctcacaaagcccttcagtaccgccgcctgtcgggaaccgcgttcaggtggaacaggaccacctcccttgcacttcttggtatatcagtataggctgatgtattcatagtggggtttttcataataaatttactaacggcaggcaacattcactcggcttaaacgcaaaacggaccgtcttgatatcttctgacgcattgaccaccgagaaatagtgttagttaccgggtgagttattgttcttctacacaggcgacgcccatcgtctagagttgatgtactaactcagatttcactacctaccctatccctggtacgcacaaagcactttattttctcacacatgctacacgtatgtagtctgtgcggggatacggtataaacaatgaaaaagcatagagttggagatgatctgacatggaggagcagaaagtgaatttttttccctccttgtttctcatagaccgactttacgacgtcaggtagaacaatgctgtaacagaacacgtcagatcccccgtttggccaaccgcgcactaacataaacccctgtcgagctagtgctctgagtcaacgcgttgttagtgccagtgctacgctttggggtctgctccacgggtcctttcgcaagacagtcttccagaagttgctgagtgggagcttcgcggcgcaacttttgagaccgattaacaacgtgcaagaagaacgcgtgagcgattaactaagacgtgaagctgagcgcaagctacgaagctgtcgagtgaatgggatccccttagcatatgcactaagagaacgcagggtgatgacgagttgggggattaacaaggccctcaagaatcctgtctccatggatgtgaagctgtgacgagcacgaaacattgtccatgagctccgaaagtatgggtagctccctggggtgcaaccccctggcttgtgctgatgtttaagcacggctccacattgccaccccattcacccactatgtgttgcacacggtcccccacgaagtcctcatgttactcgcctcactgtaaccctgaatgcctagagtgatggacagtcgtttgaacagtgacatgtctcctattaacacaccaggaatcacgttcaatggaacagctgacaccgagtccgagccgcgagccagtccgagccgagatgagccacaacgagccaggactagagccgccgaccgacaaatcccaataaaaacacaatgacacgctgaaaagttacctgggggacaatggcgaaactcaaccagcaaccagagcaggagatgatgaagcgactgatatttgttaagtcttactagaaagttagaccgtgaaacgacaatcggcacggcataaattagccgttcaatcataacaactgtcaagagaaggaacagtatctatctatcagccctcacatcggtcattgtgaaatctgaacataccattcaactcacattgattcaaggaatccaacggtatctctatctttctcatatctccagcacttgataatgtgaaacgatgacatcagctcaaggtgaatctgagatcggcgagtgcgaagaatgtcagcaccttgagagcatcggccagagccaataagagccaagtgctatgccaatagggcctgagctgaaccaagccagagcaaataagagcagagagatccagagccaaagagaaagatactaagagccagaaactcagaaggcggccggatattgatcttcatgatccaagattcgcgttcaaaaaggatgtaggaagtcgcgggggtgtagacgggacctaaccatttaatcgatagaagagagggtgtcagcatttagctgaacctttggggtaaatatattatattggatgatcaagtcccacccgaattattatctggtgtgtttctgtaaaaatagttgcgttgtgtgtgtagatgaagtgccggcacgagtacgacacaatggtcacagtgtactcacattaatcctcttctacttctttgatttaataaaaaaattagttcatgtattattagaaattcaacatcaaaaatataattactgaaatatataaacttttgaatatcaacaatggaaatttcccgattcggtaatatattactcgttttaaattgcataaatcctggaaaaaatacttttctacaccataacttcgtatattgcaatttaattcaataatatctatattgtgtgactatttccaatgtaccaagcagcccccactgctggtacctcgagaatagtcaaagtttatgactagtggctgccgacaccaacagcccccactgttggtgtttcgacgctagtcatgggtttggtctcatcagggcagccagtcccccgttgtgcttgacgcgcaattaaaaaagtagtggaaaatccactgagcccacaccgcaataatccgacaccccaccacacaactgacattgtgttttgtacactgaaaaatagccgtcaccgcaaaagagccaacatcccaacaagagccaacaccgcaaaaagagccaacaccgcaaatagagccaacacccgaaagaaaaaaaagagcactggggggcacccgagacttacttgcatcactggaaagaggcgtcagaccttgaccacgtgagactggggggcgtggtcgaagggtaagaaaagtggcatctctgcgagattccggtttccggaggtccagcagaatccaccgcctcgagcaatcttctgtaaaggaaattgagacactagagggatggggacaccccttcccaatcgagcctcacgacgtttcttcctattcaaaactgccagaagaagctgagacgaccctgatccgtggtagactccaaggaacggaaacgaggctgctctatagggccttgggaggaactttccaccaccccaacgctgcatcacctcctttgcggccctggctctgtaacctccttacagagtgggtcctccaccggcactatgtgccaaatggaggggaaccaaaagctacctcccgctgtgttagtatcgctctagagttttcaaaggcttacgtggaatcagcacatgtctctttgactgctcacctgaagtgacacagacacaaagagctagagattgtgaaaactcacccaaaagccgacctgatgagaatgaagaggactgagtcgatgtccgtttatctagtcgtagaagatgtgtcatgataatgtcgtagaagtgtcgcgaatgatatgtgtagatgatgtcgtagagtgaggagaaatgaggaaggagaatagaaggccacaaacatcttcagaataaggtaaggtgaagatgttacacagacgtgatataatgttgtggctctccaccttaattgtatgttttgttagtcgttttaccgtaataggaagaaaacatataaaatatatacgatgcatattcctagaatatgttctttatcctaatattgtatgtattgtaagaaatacagtataggtcctgatttgatatatataaggttgagataatgcaagagagtgcataatctaaatgctgtcaatgtaggcgatgaacagctgttggtaaattaaattctcttgattggaacttattggatatagtggtccaacatatttcagtccattttctctaatcctttctaatcttttctctgatttctctaaaatcctctgatcagaattgttggtactttttggttgtgtgtacttgtattgagccagtgaatgtcgtgatctccaaataccaagtcgatttaaagcacacgtaagtaagtgatcagatgaacttcatccgttgaccagtgactcccgccacttcagtacaggtcaagtgtcataatatgtgttgctctgatggactttactggagtgggctctccacttacaagtagggacgggtatcccttgagatgtcaggaacacgaggtctgctcacaatcagtggatatctatactatgctgttacttattgaagtacttggacattgctattctacaaacacctttcttcctattgcatagtaacatctatccctgagcgcaggtcataaataaatcattatcattaactaaaaacgataccgcaagaaagcaccattaataaacatatcggaagctctgggtctggtgaacgacaacaggatcgtcatcattttcaccaaactcggccacaatgtcatactcgcctcggtccagcttcttgttgattcgcttgagcaacatggatagtgcaattgcacatccaatcgcgacgagaaggaacacggagttggcagccatggcgggggcataacgaggagcagcagacttggggtacaggtatgagttccagatagaggttgtgttactgagacagttcatgagggccagcgcaacacctcgcttggctgcaggacgaggaatggtgttactcatccaggtgagggtcaccacaaaacccatatagatggagggaatcatgatgcacatggcaaagtatctagctccagtgttgagagtggcagcagcaatgataaaactggcaatggtcacacagaagggaaggacaatgtgccagcaccgctcaccggtcttatctgcgtgccaggagttgagaggcaccaacacagtggcaatgaggtaaggaggggcagtgagaacaagagtgatggtcttggagaagttaagggtctcaacaacagaagggaagaagttggtgacaccagcggcggcaacgttgaagaagttgatgccagcaaccagccacaccttggggtccttaagcacgagaagcatgttcttcttcacaaactgccaggcagactcctcagagtcaatgtcggtagtaccagtctcacgctggagacgccagatacccagctccttctcctgctggctcaaccaagaagtggtctgggggaagtcgggcagaacgatgtaggcaaagggaacaaccagaaccgtgaaagatccctcgatgatgaagagccatctccagccggaaatgcctcgcataccatccatgttctccataattgctgctccaagtagaccagagaaggcaccagagatcagagaaccgcagtacaggatcgaagttcgaagagccagctcctttcgggtgtaccaggaagacaggaggaagagacatccagggaagtagacggcctcaataaaacccaggaagaatcggcaagcaacgaggccaccaaagctgtgaacagtggaagtcagggctgagatagtaccccagataaacatgcaggtagtgaggtaaagaccaggctttccgagtcgagaaacaatcatgttagaggggatctgcatgagaatgtaaccaacaaacagaatactaacagctgtctggtactgcaccgaatgcaagttgagctccttctcaagtccacccaaccgggcagtagcgatattatttcgatccaggtagttaagaatgtacagaagcatcagcatgggtagcattcgaatatcgattcgtcgcacaaacttcttctccagaacatcaatgtcatcttgactcagagaagccagggtaggaggcaaggtagctgtgattgtggaaacgataacctcagatttcttggagttgactgacgagcttgtgctgagtcgtctttcagtgtcatcgttggtgtactccacgtgggagttttcgatcttggtcatggtgaatgcgagtgtgataagatggagtccatggtagaaccggctgatcaagtatttatactgttttcataccccagcttccgtgataccggagaaaatacggtttccggtagggttgcactagacttgcattgcatggtgacaagggcgaaatgagtcggttaaaaatgaaacatggggaatgaggggtgatattggtgtgttttggatgatatggaatggtccagatttgtctttttagctgtggctaaggcttttgtagcccattaacaatcgtagccaactatttagaaagtatagctcctttctcctctccgcgaaagccgtacatcaatacaagtctaaaatcacattccccagtttctgcaaatgcatatcagagggaaaaaaaaaaaagcaaggacgaaaattgaacctttttttgacaccccaggcctcttggggcgaccaggagacgaccatgacgtgatgtgccatccatagagggggaatcttggtcatcttggccctcttggctctactcggaagcgtttcttggcgtacaatagtcgactttgcgcaccgactttgataacctgaatagcgcccccagtagacacaggagcgaaacgcctccacaaacaagagaaaacaagactgcatttgccatacattcaatgagtactacgtaccaatagcccatttgcggggtgcatttcccaaaagggcacataatcgaagtttagacatgacacctcctgtactgtaccccactgttgcaccgattgtccatcaatgtcgtagacatgtggatacctcgagagtggtcgacaagatgatattgtcctggttttattttttcttgtacttttcggtgtattcgtgctcagacgacgggtttttgtcatactcaacccccggatcaacctcgtgcactaaactcaaccttacacgttattccgacacgttccgaaacgcctcggaacaactcggatttcggctctgctccgcagtagatgcaaattaatccgaccaggaacacaaagagactgggcgaaaacccccaaaatcgaaaattcgtgacaccatagtcataaatcgcgcttaccccggacttgttgcgaacgtagccacatgtgagccacacttcagccccgcaatattgcctttgagccttcttttttttttaattttttgttgttccttcgggggaaaaaaacaaaccaacaactttaagctacatgtattgtacaaggcacgcgcctctcggggccggaataccggatgtgcactggtggattaagcgaagtttcatgagctggtagatttgttgtagtagaagggcttctctgggcttttctggtgaaatcgaaaggcctgtttaggaccaccaatgagtttccagctacagtacttgtacgagtccagtattgtacattcggtgttgacttatgtcacatgaaaatcgcgagagggcgaacctacgcgaaccagaaaaagaattttccctgtcaaaagaaatgcatcgtcctcatgcaaggacttgtatcatccgactgtctcgcccttgtctttgtttggtttcactctgaatcaaaatgtagatgattagcatccccattaaggaccctgaaaagtttgtgcctgagatggctgttgattcaagactaccatcctggttgatacgtaaccagacaacggcagttacggcgatctcttggacccaccgttgataccaagaggtgttcctcacacgactcttcttgaactgtcatctgtcagctgtcaaatctgttgggaaagcttgacgatggatccatccaacggtctcgaagcgcggctaatgtgggtctgacattacctgaggtggacctattgtagaggcagcatctgcacttgattgctcgtatgatagttgattcgagaatgtggtccagatgtcaccgatgagtccacagacagggccaaggaatgagatacgacagacgctgtagccaagacactaattgtcagagttcaaaaacacccatgtctatcatcatgcgaacacgatttcatctacttgaagttgcactcatcgggctccgacatagagattgtacgctgatcatgctgttctggaaatacgacaggataagagtcttgttcatcaactgtgcaagtagagaagagaaggaggtggggccctacagattgaataactgctgctatacactgaatatgatatgtttttggttcccctctagcttattgatagtacagcccacgacctgtattctcgaataaataatattactgaacaataaataattcaggcaaaagccagcttttgtttccttacccagccaaccgcctcaccaactcgacccgctccttctgaagctcaatcagctgtcgccgctgctcatgcgcctgttgagcccgctccttctcccatgctagactccgttccatggtgttgcgaagtccctcagtttcgttgaccaaacgcttgagtaaatcgtgacttacgtttccctgactcacctggccaacagcatcaatcaacccttgaacactttgcacgttgctcaatcccagaccaatgggattcagctcctgggcgagatcagcctgcagatctgtatcgatatcgtccgaaagtaaggcggaaaagtctgggttgggtgtactggcagtgttggggctaggacggccgctactgctgggccccgagacatacccttgtccaggagtcccaggaggcatacttggccctcctccctgacccataccctggccttgaaccggcgaaccttgttgaaccatgccctgcccttgcccaggtccaccaggagtacctggacccatactctgtctttgactgtgtccctgaccgtgtccctgaccagcttgtcccaacccctggcccatgctctgaaccatccctgccataccactggaagatgcctgaggctgctgttgctgccgatgctgctgttgttgatgctgccgctgccgacccacccctccaggctcctcgctcctccactcgtccaggtggatcacgtgacccttgtattgcagccgtttgtcctttgattttgtttttcccgcgttgggtctccgggggtcgttcaggttcgttcctagggatgagtccatcggcccactctgaggagacacagacatggtatgttcccctccgggaataggtgtagagggactctgctgctgttgttgttgtgtgggtggatgcatctggatcggcctgtcgaataccgtgtcgcccttgtatagcagccgttcgtccttgacacgggcctgcttactctttcctatcgcctctcggaccacttgcaggtcgctgacaaactgttgagagtattccgagtcatttttgggcggcggttcgtcgagaatttcacggagcttgcgggccagcgcctggcgtccaatgtcgtagccattttcctccagctgggccgccaccttggcgtggaagaaccgtttgtcgcgttccaacagctcaatgttggcccttgagattttgagaatgagctccttgaggtctttggaataaaagacgcgttttttccgtcgaattggactcacgaaatggtccactttgaacaccattgaccctgaggagtccattttcactgactggtcgagacgagatgtgtcgagtggaggtgccaatttcgagtatcaatttggatacttgctatatgcactaccacgagcaaagggctaatctccgtcggccacttagggggtgaaattggggggtggcgaaaaaaacaaggagatatcttggtaaaacccccagcggtgaattattcccggccagaatggggaccaccaaccccttatatatcgccgtttcaacggtctaaacctccacctctcttttcttgcaccccgtttaggttgcaccccatttggccaaaaatgatattgtcaacacatgcaggtctcccgttcacaccaaagcagaaattgagttggggcagctttttattttatttttatttttttgtgttctggatacagtacaatagcacttttccagtgatggagacgcaaaaactgcagctgatgataggtgcgccccagtgttggttattgatcgcaagaaaaaaataaatgaacatgactatcgccgaaaataaacgcctcaagccaggtttcaaggttgctaatattgaaccgtgtagttatagcttttatcaaccgaccaaatattatcaaattacgatgagctactttgcacttgttttttttaaatttttatatattgtacacttgagcaatactcagttttgcatcgtttactttcttggggtttttgtttttttaccccgtgtggcacgagcctacgtagttactgcacgaggcgagtgcatagtccattagctaattggagcttgccgacgatgagcaaaaaaaccaaacagaacagaacaacaaacctttggagctgcgacgagaacacgaacgcgtctgggtggtcggggggtggctcctttgaggaacaagccagttttctgaaagacgtgctgctgggcctcaatgctgcttggggtgttatttgaaggtgctcgctgctactcaactggcaccccccagccgcacgcttcaggcaacataattctcaattatgcttaatgcttccgcaagccaacgcgaaacgaaaatcccccttccactttcggatccaattagacatcccaaaggggctgtcttatggtttgggggtcgtatcgttccgtgatcatggattgtcggcgtggcggctgcttttaattgctgcatcattggctctgtctacaagcacaagagggattttccattgacaggagcactgcgtggcgtgtcttttcttgtcttcgctacctctagttacttggatagtgcgtgttcacattaaatatctcgctaaaataagtgcccaccaaatgcacctgtgacacgcgttaacacctcagacgttaccgaaaaaaggcatgtctcagccaaatgttccacaggtcatgtcccacagcatgttttccgcatgtttccactccgtttaggtctcgccgagtctttttgtagggtctttggccaaaacacgccgctaagacgcctcactgatctgactcgacaccgtttgggaacctacttgcagaaacaccacaccgtttgggagccacggtttgggacactgtctgggaccagacgaagaagactaaggcagcaatctgggggctagcccaggtccaaatcggggggttcgacagctgaaatggatatctccagtagtcggtattcggaattcctgaaacacttactgaaacgggggcattttgtcctcataccctggtcgactgccaataagggaaactgagttccggctcgaggttgggaggcttaatgaagattcaaatcgctttactcatcaacgatacagtttagtagcattaattggtttttttctttttttttttttgtttttttcaatttctcaggttaaaaccaacaagaaatgtatatatatatattttagggaaatatattttagctactttaccttttcaagaactgcactcgtaataatactcttgatgtaaccctcgtcagttcaattccccttctgtatcatattctcgagttaatgcaccgccgaacctagattcagaatcctcgcacagctacgaatcgtagtcaccccttccaaccccgaaacgaacacgagaaaaaatgctgagaacggccctgagacgagctgccaaaccttcccgggtgcctcgaagaactctcacaacctcccttccggctctgtgctctcgaacagagtgccagaagtccgccaaccagcccatcaccctcacagccgaaaccaagtccatctcggaccgtcagcaactatattggatctcccctgagtctccaggctcggcatttttcctgccccatggccagcgaatctacagccgactgggcgagttcatgcgactgcaattgcgggtctttggctttcaggaaatctcgtctcccatcatgtacaaaaattcgttgtggaagcagtctggccactgggagaaattccaggacgacatgttcagagtgcagcctggtcatgaagagacttctgtcgaggaagagttctctctgaagcctatgaactgtcctggacattgtcttctgttcaacagtctgaaacgaagctacagagagctgcctctgagatactctgacttctcgcctttgcatcgaaatgaggcttccggcgctcttagtggacttacgcgtgttcgacggttccaccaggatgatggacatattttctgcactcctgagcaggttgagagtgagatttcgcgagctctcaaactggtgcagcagacctacaacacttttgggctggagatttcgcgtgttgtgctctctacccgtcccgagacatttattggagatattgagcagtggaacgacgcagagaaggctctgacctcggtgctggactcatggtctgtttccaagggaaagtgggagctgaacgctggcgatggtgccttttacggtcccaagattgacattctcgttaaggacaagcatggaaaggaacatcaaaccgctactacgcagctcgacttccagcttccggagcggttccagctcaagtactttgatgcatccgagaccgcccagaggcccgttatggtccaccgggcagtgtacggttcgctcgagcggttcttggctattctgattgaccattacgaaggtaagtggcccctgtggctttcccctcgacagtgcatggtgctccccgtgggagaggctcagaacgagtttgccgagaaggtagctgcccagctgtctggccttccttccatcacagatcagtccactcctctgtctgctagcactttgttctgcgatgtcgatactcgatctgagacactgggccagaagattaagcaggctcgaaacgagggatactcttatattgctgtgattggcgataaggagatgcaggagggcaaggtgactgtccaaaagcctggtaagaaggaccgtcagcttctgactgttgatgaggcccgagactttttccacaaggagcagaatgctttcagataacgagacccttgacgacagcgtcaaaattgtacatagttattgataaaatgaaattgagccacttcataagtgtttatttcatttcattcatctttttgaggtccttttcagctcgaacctttccaaaatgcaatatgtcgaaaatctactcaacccataatcgaacccacaaactacctcattgcagccacccagggctcagttagtaatcggcctgacgttgtttgtcgaaactctattcgggcggtccttcaaggttttggaaaaatcagtgtcacgacagacaagacatccggaaacgataccttggtacacgtgcgtgtggcattctaacggctcttccaactaaccatctttcgccatgtccaaccaagtcgtcaagcagatcctcaagaagttggatcagtggcccatggactctgtgaagcattatgcctctttccgagacaccatgattgagcattacgagcccatggtcaaccagacccccacaaagaccgagcaggccttcctggagaagcagaacgaggcttttggcgttctcctcagcgacaaatacatgaagaaggtgagtatggccctcaggagggtgtagacagggagcagacagggagcagacagggagcagacagggagcagacagaggatgagacgggaaccgacaagggtttctctgtgagaatggcaatccaatgatacttctggctgtgaatgagagtgttccgatctgggtatgcttgggttctataacgactcaggactcagtagacatattcagcttctcgttgggcatctgcaaaaaaccgatgttgcgtgctctgtgtccatatgtgccctaactgagagtctcaggcaatcggaacatctcaatggtttctctgactgaatacctcatgcttccaagtgtgagagaaagaggaagactacaatactacagatacagctgcggacttgtgtccctgtacagaatctctactgcaattgcttcttgcctacgtctattgcagctgcttcaggctcgcccgatatcccttaggctctcctattccgtttaaatactaacacagttccccttgacagccgtcactctcgagccaccaaaggaccccgagtactacagtcgactggtgcaggatatcggagcacccgaagacaagtctctcttgggcaagcttcgtcagtacattcgattctaaaaaaatctgtatataagttatgaattggcatgttgtatggttcgcatatggacgtagccgtgagagaatgggttgagtgcaagcgaaataccctctttctctcccccatcttagaggacccagtcactcactctctagggctcttatcgtttggtacacacgataccccgcttaaatttgtctcatgcaagtgagcgatttgctcttgtcttcactgaaccccaaatgtctgaagataccaaactgcgaatgaagatggagcgcgagctggagctgcggcgcagcaatttggacgagctcaagtcgcggctgaacgagcaggacgccgagcgacacgagtcccaaaacgaacggagcaaacagacatcaccaaaggtgatgatacggcggaaggagtactgtctatgctattgctgcttggatcaatagtagtgggatggtacttggtagacagcgtcatgcttggtgagggagacggcaccgtactcaggctagcgtgctactgctggtggaccgcgattggctgatcttggcagccatcatgttgctcggtgtcggctcgttaatgagctacgaactgaccaagggtatctggtcgccgctggtccagtggtcatggccagcgcagccatatttctgaaccatcggcatcagaacgaaatccatcgaagagaacaggtaaggaacagcacaatcgaaagaggagctagcaaatcagctctgataccaaagataattacagtgagtcggcacaaatctcacagctaccacaacacactctctcactaacatgaatggcaaggttagcacgtttgccagaagcgccagtcaaaacatgagtatcattgccctacctgtctaccccattgcctccaccaacccagtgactctcttgagggtacaatacagtacaataggtacttgtaccttccatctgctgtctcccaataaaccgcttgtggaaaattttcttgtcagcatgaagaatcacttcctggatcgatctgtccactccaagttgacctggcatagcttcactgtgaaaaggacattggagagaattcagatattgcaaccaaggggccaaccgaggatgttcaagtatatactgtaggtactgtagctacagtatttacagactttgatagtgcctgatgttcaaaaccattgtcatacaagcatgtacatattgtacagtagtcgatagacaactactctacaagtacaagtgcaagcactgtagtcacgaacttccacacccaacaagttattgccgccattccaagggaaagttcccgatacaccgttgataccaccatctgccttactatcacacgatcgcacgctactcccctaacccacaatcgtattcgcttgtgggttagggacatgcataaaaggcacgccaacacagccacgatgccaacggtcccatatgtgtcttgtacgaggagagagtatacgacgagctggatctggagatttgagattcggcggtatttcgaaacagctcttttaagctcccaaaaacagacgtgcagataatatcgatcagactgacaggacacaagtctgcgcagtagctcgattctcatgcaggcaaccagaattgcaaacggctgtattttgcttcttttgtcttgatttgaatacgctttttttggacttgaataatgtgtctccttagtacttgttgatccactactcacatgatgccatgcgatcatcaccgtctccaccaggtcctccattatctggggttgctcattgacttcgcaatgcagcgtacattgagtttatctctaacaaccttgcatgacttggaggagtcgcgcaaaccgaatccgaattcttgtcaagttcactacgtacgagtaccaatacttgtatcaccttttgctgcaccaccaccaccatgctcaattacagcaaagtaattttcataggcgacagtctgacggagctgtcgttcgacccgacacaattcggcctggggtctgcgctgagccaccactttcgccgcagagccgatgtctacaaccgagggctgagtggctacaactctgtgtggctcgaagaccagattgacaggatatgcctggagtttgaagactcagcaagtcaggtggtgttgatcattctgtggctgggtaccaacgactcagtgatcccaggaaacccacatcatgtgctggagtccgagttcctcaccaatctcaagaagtacaccgccaagttgctgagcacgttccccgaagcaaatcttctgcttctcactccggcgcccattaacatgacccaactgcaggtgagtaccctgagtgacagcggcaaagcaaggacacccgagttggcgctgcaatacgcccaaatcgtggtcaggtttttccgggaacaatgccaaccagatccgcacgtcaaatgcatcgatttgtacaatcttttgggaagcggcaaagatgacgacttctacgttgatggcgtccatctgaactcggcaggatacagagaagtgtggaacgcggtgcatcaggagcttgtgggctgggtcgaactacctctgatcgagcctcattggacagtcaaggctggagagcagaagctaggggaggatcacaccggatgagaaattggaatatagcatagatgggcattggggcatgtggcttctaaacgacaaaaaaggaacatagccgacgatattactgcggcatggagtacaattagcatgggaaaagcattgactagacagtatatatgaaatttatctgtaaggatattcatgaacatgtcctagaccacaagtgggttctggctggctttcagagctaacatcagacaacaatacagcatgataagggaataataactagaagagaacagttgaaggtgaataatgcccgaaaaaatgctgcaaatgtatcttcaggtgagaaattattatctctcttgtcttcctgtccctgtctccgattcccaagacgttccaacaatgctggaaactgattttttgacaatttgcttcgttggaagaaccagaagttcactaatatggattgtaagacgttagaggaaactatggccaaaaatattagtttcccagcacggaatcaccatgtatgcgacaatctcacgatgtttccctgtctccacctttcaaagatttcagtcaagcaagcagccatatataataattacaagacagaggctgctctagaattgaatgtctcattctagactctgactgaatgaattagcccgagaaagggaatatcgcttgttcaggtatcgaggacgatctgatctacactagaaacagagtgagtggagagacaatcctattccacaacagtcaaccatgacgtataatgggctgctattgtgatcgaacgagaagtactactatcaggaatgctttgcaactaatcatatcagatttcttttccccagacctgaattgtggttgaagtcaggtacaattgtgagtatgggctcagtctgaaacaaatgtgtgtcaatcttcttgcagccagtccccgttgctttaggagatatttctttgaaactgtcaatagcacacgtttttcgatatccggggattcccataatccgacactgcctcgttcctgaaacgcctctgtccctgaatgtctcattactgcgtctcatcccccttgcatactgccaagagaatctggaggagtgactgatgtggagtgcttactgagaatcaggcattgttgaaagcatacaaaggtacagtacagtactgtacatacagtgtgtagagtgtttcaaacgtcttgttcgatagagacgctttactctcaggtcgaagtctcctctactggtattaacgattgccccttttgtagaaaactttcatgcttccgtgtagccctccccctgaccagaaaaaacagttaccgatgaagcgatacttgctagaagttcacaatgccctgaagatcagtttcatcaaagtcacttggctcatactgcgttttatatcgacctccaccgagcccacattaagttatgcatcctgccgcgttggcatagagccgccgaggaattagattggaagaaatatgaaacccgagaggccgaatgaagctgaaacgcgataaaagatggtattttaaagagctgaacatctccctgccagttccgtagcctccccccaaccccatcatgaacgtcgtgacacttcttctttacgtctctacagtctcagctgtagtagtgacagtcacgctcatcgagaccgcccaagcggtggattcttcaagagctgcaaccaccaaaagtatgacttcaaccagctcttctagtcgagctcagattctggccactggtactcctccaatgtttgccagcgccaagaatgctattatctccaacgtcagaagcctgaaggtcccctcagcctctggctaccttgccaaagatgtggagccaacccagagcgttactccttttaccttatcgtccagtgtttctcccgcaactacagcatctgccaacccgaccagcgctgtatctgtcgctcagactaactctgtctctaggactggtgtcagcgtgatgttcttgagcctctcttttgttttggtgacgtgctctattgcttgaacgtactctcagtgctggacattgacaacagtccatatatttataactaacgtatacccatgaatgaagacttattactcgaggttgttgtagaaatattggagaggagtgacggagagtgcgagaacaagaagaccaagaaccccgaggctgatccttctcccaccgcccctctggccacctaaaccaccattgttgagggtgtcaccaagaccatcaccgaggagtgctccactgaggtccccgcttctgagggccccaagcctacctccgaggctcccgctgcctcccccactctttctgcttccgtcgacctcaccacaaaggtcaccatcgttgagggtatcaccaagacactgaccgatgcttccaccattgcccccgctccttatggtgagtccaagcccgagcccaagcccgagctctccgagggtaagcccgctccttccggagggaggtgactacgtgacagaaacttcactacagtacactgtatacgacttttccgattcttggacatttccttaatcaaccttctcgacaccaatgctcgaaaaatgaaacgggaattgttgaagacagttctctaggctaaagtaaaagctaccaaactaatgacacagcttaactacttcagatatttcaactcaactaaagatacgagcatatgtattcttggaaccatctaaagggttggtcttagccaatgaaagattcacacgtaaaggatgttgtggggaacttgaagaatacctgtaccacctcctgacacagcccaccacaaacaacacaaatgacaacttcttttaccggtgtccatacagccaaacatgtgtgttccatttcacgtttcgcgacttggaaactaacataccgttatgcgagttcccacgaaccaagaggcttcagcactctagcagaagtacatacagtacgagtattgtattgtagctgcttgtactcctacttgtgtttgtaatggtacaactatttggcctacagtagaagacgtggtaccatacagaccctatacgtctcgggtccagttcgatggccgccagttgtgtctttttcaatgtcttgttacggaatgcgcttgatgtactttcacggcatgtacagtatgtacagtactcgaactcatacctgttccggcacgtgttgaacgtcgtgaatggaatggagacacacctttgcattccttaccccagctttgagagtgtctaattcaccacgttaaccttcggggtatattattggttgtgccagagagggctaataaaggacttaaaaggccgtggttttggaccgagaaaagtgggatttgcggaattgaacgcgcttttcatcttcagacggctgacgggcgtctctgtctccgtcgaattttcgccaccgccattggctcagcaaccatgctctgtctcatcgtgctcttactgaataaccatagtggtcagcaccacttttgagttagggcatctaggttaaatcaagaacatgtgggggacccttggtggcgaactgtcggtcggaatctgattatttgaaccgtggcctgcatatctcttgtggtccatgtattggtggtggcaaaacctgactgctacttgtagacacttgttgttgctctcaatagccaaaataaagaccccaaccacgtggacagaccagcgatggttcaaaataacgctctcgagagcgccaaagtgtccaaattagtcgtcaagacagctcattgcggctgctcatagctcagttgctaaggcacaaaagtgcgacaccacagcaccctgtattgggaatctggggtatgtacatactgtacggtaacaagcaccgtagttgttggagtgaaggggcgctaggtccccccagcagtcggacggacacttgctcttttgagggaataagtatcgtatactcgaaccagtggaaaccacggtgtagagtcgcttcgaatgcaccacctgttccctcattattagcaactgtttatttccaaatccagcagaaattacctcgacccgtttcttatctgggaggaccatgctggacccaacaacgggtaacagtgtgattttctagcttgaaagtgtgggaatcaaaagagaaggggcatctggattaatttttgtcttcatattctttgtaaacaccgtctggcagccctcataggtggtccgaattttggtccttctgacatcaccgcgctttaggttatccgacatgcatattcatttaactgcgtgaagcgactcaacacaccgtgcaggcacaaaaaaaatacgcgtttcggatctcaatcctcacccacaacccactcagatttggtctaccaagtacaggtagaattttggtgagtacgacgcaagacggctccagcgacacgaaaacgagtcgactaacacagacacatgaaacatggcaaacaaaagctcgcaaacaacaacacagatcatgatagcctgagctctctggatcgggcccttgccacccggcgggacatgtttgggcgaacgcttctgcataatgcgtgcatttgtggagatgcccaggctgttgagcaacttttggccaatccccacgtggatgtaacggcggtggagtatgagtcaggttccagcgcccttcatctggctctagctgcgggctctttgcactgcgctcagctgctcatcaagcattcgcgagaactgctacgactcaaggaccgtgacggctgtcctgctttcgaaaccgctctttactaccacaagtggcacacaaccgacccaggactgccttccgagtacttcagcttcggatccaacacaaaccacacgttgggatttccggactcagacgacagacagacccccgaaaccgtcaaggtactaagaccagccactacagacatcagatcaagcctggcacctgtccgggtggtggattgcgccattggaggctaccacactgcaattctcacctcagatgagacagcaaacttgtacgtttgcggcgtgagctctcgaggtcgtctgggcttgggcccccatgtttccacccagttcacaccaacattggtggcgtcgttggcgtcggagaaaatcgtgtctgtaggagtgggaaaggatcacactgcttgtgtcactgccaagggtgtggtttacacctggggatgcaacagggactcgcagttaggctacccaacaggaggagccacaggagaggagcaacttcagatatcacctagaagagtgggcggaccgactctcaagaaagcccacatcacccacgttacatgttccaacgtccacactgtttgctggcgtgaaaacacctcagacatgtacgtgtggggtgctaacaatggccagatgggaggaatggcaccagggcaagattgtgcaatccccaccatggtggctcttgtgcctggaaagatttcggctgtctgtgcctctgattactacacggcctgtattatcgacgagtcatacattcaggtgtacatgaacggtggtcatttcagagtctttttgcctgcgccaggtggcacagcaagagaagaaagtcagtctgggtttgatgttttcaagccacggctgctggtgaacagaccccaacagctgtacgcttcggctggaggacccactatttgcgtttcttctcttggacacgtctacgagcttccgttgcagaggtttctcaatgtcaagcctgccctcgtggctcgacagatgcccgttacagctctatgggtgcctcgaagggactacatggtggctacccacgctgctgttggtgacgatggctcagtgataatctgcacttcatctggttctgcttggaagcgtgaacgaaaggaaaacagattgggtggtggcaccttgaaggagtacaagttttcgcgtattccaaaggtgactaatgcttacagggttgcatgcgatcccctcttcagatcatttgctgctttgcggtatgcgactcaggtggatgccatcgacgtggatatggagtctttggagttcgatgttgctgagcgacatgccatcaaccgcaagatggcatatttcaccctcgatggcgacaaggagagcagtgaggagtttgaggactcgcccaaccttggcgcgctgaactggcttgtcgaagcgttcgagggtgtggtgagtggaactgcacagcggaccggacttgaagaggaggctgagatgatgggtctgaaccgcttcgaagagactgtcatgtacaaggccgtcgagatgaataagagtgacccgcaccgtggttatgactgtgagctggtttgtgagaactccactgtcaagctaccttgccatagctacatgctacgatcaagcaatctgaaggcggccgttgcgaagaacagtcctctcaagtgttcgctccttactctcgttattttacaccactacctttacaatgacaacgtgttgagtgtctggacactaagcggaggttgttcgattccgcgagagtacgttgaagccaaggccgaattgctggcacttgccaaggagtttgaactctcgtctctagtctgcaagctttcctttggagagaccgcggaccagcttcctgtggacatggcgaaactgttttccagcgatacgggtgatgttgccattgaagttgatggtggacagattctacatgctcatcggttcatcctcactcaacagagtgagttcttccagtcttgtttgtcggagcgatggagcgacgataccaaggttgtggttgacttatgccatcttccggccgcgtctgtacggctttgtctgaggttcatgtatactcacaatttggattccctgtttgaccaagtcagttctaaagtgtcaagcaaggattttattgccacggtgtctcagctcctgagtactgccgacgagcttcttctgacaccattgaaggagttttgtgagctgattctgagcgagcttgtgacagtcaagaacgcagcttctctgcttttcctcgcctctgcttacaactgtgacaagctgatgaccttcatgtttagctacatttgtgttaacatggagtgtcttcttgaaggaggcttcttgggtgcaatcctagctgatggagagctttttggtgctattgaccaccactaccgcgtgatgacaggcagagagattgtgctcaaagaggttcctgagtcatctgctgttgtgggtgtcactcagctcggagagggcatttctgaagatgctgctgagcaggaggaggtggaagaggaagtgaagccaaagacattggcactcgcttctcgtccatctggctgggtggagtcttttctcagcgattttgatggacataatgaacttctttgtcgtgtcgccccagggtctgttcaggctccagatgctgctgctgctctcacccctcatcgacagtcttttgctgctctccatcgcaactccaagagcgaagagactcgtcccagtatttcaccaatgtcttctcctgacttgcgtggtcataatcagacagatgacgtgtttgaattcgagctggatgaatgccccgccgaacaacggaaacgtcacgatagtcgacacgacgatagaagatgcagtcatagtgagtggagagaagtcaagacgggcagcagcgttcgaactgctcagttcagctcctctcctttcgggaaatctcccatggctggatcacctctgtcggtttcgcctaaccacgcttctggtgaccggcgacgatcttcgtttgcgactgcagcgtcaggtgttcctctgacaccaggagagattcggttcaatctcaaacagcagattgaaaaagactctgatgcagtctactggcccactctaggtggtttgggtagccctggtggagctggatctgtgggagctgcgggcgccacacccggaagtcacccccgaggcagtccaggaccgtcggcaacgcccagtggctcttcaaccccttggggcaagggagctggagtgtccaatgccacacctggaagtgctggttcagcctctacctggggcaatagcagcgccaatggcgcatcagccccgagcgcttccgccacgagtgctggctccgcactttcggatctcttttccgtgacacctccttccagcaagctttctcagaaggagcgacgacgtttgctgaaacagcagcaagaagagacgttgatgcgtgctcaagagaaggaaaagcaagccgccgagggcccttggaaggtcaagaagaaggcacctgttggtgtctctccttttgagtccacctcaagtcctgcatcttccaagacgccttccaagactccttctagagcaccacccagagctccatcaagagcagggcttcctggccctaatgttggtgtcggtatttccactgttggcaattccagtgctactgccacttcttcttttgcatctgacttttatgccgcctcgcagcctgttactgctctgtctcttgctgaaattcgagaacgacaggagcgaagcacacagaaggccaagaatgttaagacaattgaggaaattcagcaggaggagatgttccaaaagtggtgggatgcggaagttgcacgtaacaagggggaggagagccggggtcctgaaggaggtcccaggggaacccccagcaagagctccaggcgtcctaataagaagaagaacaacaacaaggggcctgctaatgggtctagcaatggaggagggggtggaagcgggtctcaggatgataatggcaagagacaccggcctcgaccacgggagcagatcaaagcgtgagatctgtgtttggacagttatttattattgaatgtatatagaaattagatcaatcttaccaggagttgtttagagcgctcatttgtccgtctgccacaacaaacagactgctactgtgcatgcatcaggagtgaacatgccaaatgttccagaaaccgccgatcagttttacgcgagagatgacgatcttctcgaggcttggcattttatgaacatcagtgggtccccaaatgaaacaccaggggggaggaatggtttttttatttgtctatatatacaaaggcaaaacaaaacagctgtgtggttactgtagaatcatgctgtcttggatttccgacttgtctcagggcatattctaaaaaaactgtgttgatagttgctgttggtggtggaacagtgtcagaacgaaggggttgagcaaacattttcgacatgaatgttgaaatgtaatgcaacacaacacgttgcgccgcagtattaaatcgcgcacccaatctaagatgacaggcttccacacaggtgtgctcacgggacagagtgtagtgttgcggctcggaaagccacgcaaccctgagtggcctcggcaatctagatgcacatgcaaaggcgatgagttgtcgttttgccctttttggacgttttttcgattcctctggtctccttttcttttttccctttgcgcacatattcgggccgaaatgtctccgaaatgacggctggaatcggggcgcataagggtgcgtgttcgctgcgttcccagctgcacagttgaggtcaaacttgccggtgtcacgtgatattcccctgtcgatccccaagcggtcttatgccttggaaagcgtgagccatgctgctttcagaagtaatggtgtatcacaccccatgtttcgaactcggtagcgtcgcctctcttcgtttctctgtaatgctgcactcttgaagagcggcggggaaaatatggggagctgattacgagagcgacctgaccaaagcacaatgactaataccccggttccgcttgacgttccacaagaacaggcaatcgagtacttgcagcgaacaggccattgaatgcttgcaccgaaaagtggtctatatttggaagagttgacttggaactctgcgaccacgacacatgacgtcgcatgtcctcaattggttttctaatcaacaacttgccattgcaccgcttcgcatacgataggcatacccttgatggagataatgtacgccattatacctccgtgaaattgtgggtgtcattcagttcaaaagagagtctagccgaggccgagagccctcgccaagcgtttcccagaagtatcggggccgttatctgtcatcttttgagacgagagtccttttcccgattctcaggaatgttattatgatttaattaccacgtctggtgcacattttaaatcaaaagtaaagtgttactgtaatcataccaaagggtggtcatgtcgaggcaccgaagcaaggtatgcaacgtccgtccagcgtacagcgtccagggttcgttttccacatgaaatgaaagcacttgcattattatgtgggtcaccagtcaccagtcaccgtccagtggtgccatttggcgttagtacaagtacaatattgtgaagtagggtatgtactactttgttgttgaaggttgtactttggaacttgccctcgatttattgttggtcttacactctacaattggattcagaaaggtccgttttttgtggtttgccattcttttggttttgtggtcttgtcatttcgtctggtttgtcgatttttctgatatttccatttcccctgggtttccatttccctgggtttccatttccctgggtttccattaccctggttttccatttttcgtgccactttggctcgactgtgcttgtctttgacaaacatgtctctcatttccctcctcatttttgggtctgagtcttgtacttagacttttcccgcgtcacttaaacattcggaagtggagccgccaaccctaaaaataagctcaataggtcttctgcctttgggggcaaaaccaaccgcagaggggccgggaatccaacgaagagagagagggcgcaaagcaagaagattggggcctgttaaccaacggatgggtgtttttcaaacacaattgtttcttggctttgcaacaggagggagagagagagagagagattggaacgggggcaactgacaagcctcagccccccagcttcccttgttgagccagcctcaggtcaatcatgatatatccattgtcgatcattggtggacacagcactccacaagctaatgtgagatgttccccatttcccccccaatagcaacccctcctacaattacagtatagggtatagacataaactactatccgatttaccggacgtttgagttccagggtcgcatttctttttttccacctacaagcagtcacagtgtagcggcggtttgcacagccttccagaccttgaggttcagcgatggaagtccctgcggaacatccggactttcaaatgctcacacgatggttattgatggcatttccctgcggatttctgcatctggggccttcagccgtttgcccgctgtctcgactcggaaaaaaacgggaaaaaccaaaagccaacagctggctgcaaaaaaatatatcgaaatacaattaactagaaaacggacaacccccaaggctctctgcaaaaagcaattttaatagacggctcgtagattctttcacgggcgaccaacggcaaccattaattctaattgtgggatcgactatgttccccaacaaaatgctaggtggtgggccaaaacccgaaagactaacacgctcggctaatttgtaaatttcgggcgttttgggaaataaagtgagacgagggtttggggtcgggaagaacagggtaaaaaagggtaaaaaaggtaaaaaaagggtaaaaaaagggtaaaaaaaaagagaaaaaagagaaaaattaataaataacagagacaaccatcaaagaggaactgaaagaactacaagaagtagaggatctaagagggcaacaacaccatcaacatcaactcacgtgacctcaatgtaattaacttcttggactttcccccgaacagcagttctttgcccttgtatgagtatttctaatgttacagagaaatgtgcgccgaccttggagactttgaaggatgtcttttttttatatttttttttaatttttttttaatacctgtagaagttttcacaaggtgttgtatcgtacaagtacaagtatcgtatcgtacaagtacatactggacgtagaatagggagccccagggagcttcagatcacgtgactatcggcgaaaaacctacgtcgaggcgccagtatgggatcccttttgcatgaagcaattggggggggagatcagtcggctgtggacttgtttcggtatggatttgagagatacgtaactataaaaaataaaaaaaataaaaaataaaaaataaaaaaataaaaaagagaaaaaattaaaatagagagaaaaaaaacaaccactcaaatcacgactttgttcctcaactttctgctacagtactaaactcgtattgcagccataaatactctccccactacagtagtctcaaactaatgctacattagcgtgatgaccgttcctttgtttaaaattaccctctctctaacaccacgttccataatatttatcaacgtgcataagcgcattgaaccttggtccacgcatgcaggaatgcatgcttggtacagttacaacgatcattgtatcatcacgaccgaccaagtgagtcacagtagatctgacaagcatgtgatgttgatgccatgtgagccttagcaacccattgcattcacatgagataagtcttggcaccggctcatccgaagctccccaatcatgctgttccagatgttttgtgatggagagccttgaaactctaaacttctctgtcacctgagccccatatcggtgtttactcaagtttttaactgcgaaattgttttttctcgtctagataaagcctggcgaggctgagctttgagctttgagctttgaggggcttcagttcgcggggcgatgctgcgggggtgctcatcttccgcggcttcagatgcgtctggtcggatcgcgttttcgtttattatttcctctaatgagatttgttgtcgtcatccccagaccttcgactgtaggtaggagcgaaatcacgttacgacatccgacagccggaatgctgtagaaataaaagaaaaaaggatagccaaaactcaaataaattggtcacaatggcagattgagctctttgtcctggactatgatgaactcacgttgggggagttgagggctgaaggggcggttttaggagaaaaatataaacgttgggagggtaaaaaaagcttgccgagtcggacttggatctctgtcttttgctttttctggttacttcttctagaagttgctctgcaaccctgtggagaagcccgacatatattactggagagcatttaatcaagcaccttttagggttaagttcctcacggccagtaggttgtttctattgatgggtatgcaataggtgcacgtacttagtattacttggtttcaagtaatttacaagtacgtaccaactaattgtagttactgtaaaatgattatgatgtttatgataaatatattatagttgtgatgtttatgacagttatactgtatattgtacttgtattatgccggttcttgtgcttttggacaacttcagcattgaacggaatgtatatcaatcccttatcgttggccctactattcaacagtcgctgagaacgaccttcatctattgtgcgaccaaaacagcagaaaatacccgtttatttgtctcgcctaaccgatccaaaaagctcaccggcatcttattatcccaggatggcatgcaccgataccgccggctttagagcactgtgccgatatcgtacctgtgccgaatttgagccgccgccgtgtcgcaaaagtgaatctgcgaatctgtgatattatgctgatcatggagcactgatgcaactgactggctcttgtccttttgtggtatgaagaacgaccttgctgaagatctctgttgaattggcgcaacaactcctcgtagtttaaaagatcattcgatgtcactatcgtacaagtgctgtaactctcagacccaccattcaggccaaagagatccttgtcctgtacaagatgcagctgaatgagggttctattagcgcaataacgcaggtgcgcagagagctccagttcccgtgttaactcggatcatctggtattagagaaaacaaagacccctggtactgtcaatccacaagctcgtcatctctcgcacgtcatacgtacgatacaagtaaaagtacgaagtatcgatgcttgtccagttcatatcaaaaccctgaaggcagcagtcgaaacaaaaactacatacagaatcatagccgaaagaccatctgccaaattgctgtcattcttgtcgacaaatgttctcaaatgttgtacctctaacctccccactcttgtataacaccatacagtatcagtatgttacaatattgtacccatagtcactcgacaaagctggctaagattgtaaacctccgatgccgacaatcacgtgattcccaaatacttgcccccaatccccctccatctgtcaggaaatgatccgacttccacggatgtacacattacacatgccgaatgactgcagacaaagattcacgtgacattatagtcatacgcccaaggttgccaaaaaaaacaaccacacactaccacaccatacaatgcgtttttttgaccccgttactctgcataccccattgttcgagatcctacagcgcatggcatgggccatgttgcgtgacaaggccattgtgctcgcgtgaggactgcagcgctcattttcagggctaaatcccaaacgccaaagtcctcatttcgcggcctgcatcagtttcatctgttgcaagtccatgagagtttgtgtgcggccccgagcctcactctgtattctgtcgatattatacttagggtttccggatttaggactagctcaacgttcggtgagagtttaactttgttgacatatcttgtgtctttgttcttctgttccaattgcagatgcacacatgtagctgcatgtaggtgcagccttgcagtatgtgcccctttggcggcaccaccactcacgctctcccgcaagctgcaacaggctctgtacacccagattattgtctccgcagcctcgccttcacccatctctcctttcttcttcagcacccatggcaccatgatacccacccccgtctataccaccgaagcgcatcccattggcgtgtggcaggcctggtactcggacaatttggcggcgattgaggactcctcgaaatatgtcttctacggccccaatggccataacgacggtagcaacgaccttcagcagatagcggtgcctttctatcccgagtgggctggacctgtggagggtagcaacggcaacggaagcaacgggggtcggaatggcagcggcaccaatggcgggaaagggtctaacaacaactcctctgcgtctcacgatattgcgactgtcgccatcccgacccagcctcgcacgccccgcgacacgtgtcccaaaacacagacctcagcaaacatgcgcgtatattccccctacgagtacactgacagtctcaacaagcgagtgtgctggacgccatattttttgggcactgaacgacaggagtttgactctcatctgcgcatgtttatgaattattgccgctgggccaacatgagactacgaccggccccgcaagcggaacgtggcgacgtcaaagccgaggtggtggtgaccacccaagcggctgggtgcatgctatccccaggcacaaaacgaccgcgtaacaacggcatgttggatagtatcagtgaagcccatgatagagctaacgccacaacccccacctcgaatgacagaccgggtgcaacagcggcttcttcttcaccccacggccgaggcatgccaaatgcgaaaagaccgagctacgggtcagtaccgagctatgtgacggcaggtgccccaaactatgtggcgacatcgtcaaccccaagttacacagcaactgccgtcaattccacatatgcgcctacaacaacgacctctacatcttcgggtgccacaaactcgccatacacatttcaacagtcacagcagtcatatttaccaccgccacaaccgccaacatcgaaatcaacaacctcgttgtcaccatcaatctcttccgggtcacccaacaatcagagcctcacatctgtgtcttcaatcagcagccccgtgacttcaccatatcaaacgccgcagacgcgcccattggttcccgaggcagcccacgccgcgcaagctgggcagccgccttccacccaacaattctactcggcataccaaaactactacaacctatcccctcagaacgagtttcagccctttgagggagactaacttgccattaacggtgcctattcaacatggcccaaccaacccccaaaagtgagtatctgtgtggactggattttgttcctcaccaacatgaatgtttgttattgtttattgtgtgtacgccgaaattgtgtgcccattcttgtgtctgacgtttggtgatattctgtgcttgacaccgtgtgactcctttttgaaatgacctccccacattttgcttccctccttccttttgtttttccccttcttcttcttcttcttctttttttttttttttcctttgtctagaaagacctctcctattcatttctctcgcttttttttgtttttgtttttgtttttgtcactcagctaattagcatctctcagcccaactcaatcacagaatggatgccacattgctgtgtcattatctggcactcgtgtctcccctctcacacattccccgcgcacagacttcatatttgttccttgtctctctgttgttttttcaacagtatccctctctctctcaccctgcagctttttctctctcctctacaagtgtacttgcatcattcaggtttctttctttttactgcttcttctaacaagtctaacatcagagccaatggaccaatgtccaccacgcaccaattcaagtaaatagtaattgttattgtatttattttattgttcacaacgcgagctagggctatatctgaacctccgcacacaccgaggcaccatggacactgtattgatttgagcaatatatcaggtcaaggtttttaattgatgtcatttcatgtcgtataattgattgatatttataacgggaaagtcgaagacaaaaacgacaattggcacggcaacaagtgagacaattggcgttagccggtgacgtttctcaagccctaaatgatgccttgaccgtgagtctgagtgcagtaagtggacagatgctactgaaacaaaaaaaaaatctgtcgtcattttcagtcgaggcattgtgtgcagttggtacgacactttctgcaggtctgttcatgattttgattcgtgctccagtttctttgtgttggtttcaggcacacatgtgaactgttatggctgtatatcttgcggagaatggatgactttgtacttccaggaactggacatgtctttacattgtacaaaaggagcaattcctttcctttaacttgtcgtctgtttccgagtttctcatggttcaagtctgcttttggtgacgaacattttcaaggttccgaggcatcccctgtcagtcgtgctggaagggctgattgaagaaagtgcaacaggttgctgtcgttatgacacggattttctgtgggctgagcaagttctgcttcggcctcggtagtttcggaattacacaactaaagacaactggtacttgtactgtactgtactgtagggacctcggaagaccggctaaagctgtcccttccaattgaagaacttcccagaaagacaggtagagacgccagtttgcacagtagctgtctcccgcaaatattgaagttgatttttcgtactttgttgtacatataagactggagagacccctacttgtagggtcttttgacgtctgctcggcaaaaacagatacgaatgtgatttttggttccaaaaggtacttatacatacaagggaccaataggtaacttgttcagcctcgattccactttgcatggaatgtacgtttttctggcctgtgttctacacctctcccagtagctactgtaccaatctattgtccatctctctctctctctctctctctctctctcgctctaactgctgctaccatccatgtctgttctgtagggtccaagtgcatgcacaaacagatgccgccgtattcgtactcgtaccataagtagaagaaagaaagactgcgccaatcagcgtaccacttgttatgcagaaggacacaggccaggcaagagttggactgtctacgctgtcctgtgtaactgccttcactcaagatacactacatgcagcaaggtgtaagagtgccattactctctcactttcatcattgattggagaaacgggtgaaacttcaagttactgattcacagctacaagcacctgcaaaatgacatcaaaagaccttcacgattgagccacaactccagccactacctgtagtacatactgcacatacaatgagccgcaggtatgtataggtgcaattgtaatctcttggcaacaaccgtccatccggcagtaaaagacaacgaaccattcattctgcccggactcaccaatgtcccttgtacagttgaagtttttccgcccaagaccggagattttagacagcagaaaaccccccataacgaaaaaaacacatcgagtagtcacgtggtttaagcaccaccactttacttctcattgtcatgcccctattcaccatattgcccttgtccatattgaccaataaccgaggcacatgggggatgcaggtggaatttttcaaatcacgtgattaatggagtgtgcatggtttctcgtgacttggaaccttgttacggatgacttgaaaatgcaatgacacggcacggttgtccccctctacaagagagtcattaatcataaagtactgtactgtactgtattcgcaattacttgttcacatctatgtgtttaagaggtggcaagtatgatgtgggcgtgagaattagtctgtctgacattatcacgctatggggcgtacaactggcgcgctggtggtgtcaaagtaataataaatgactatattagaaatagactcgcgtataaaaataataacggcgccgacacggaccccggaaatgaccctcaggagattaggtaccaacgaaatcagatattctgggttcaaaagtcacgccttgcttggatgtatgtagttaccaagctcagaatctcgaggtatcggaggttgtgtggagttttcttacaaccttaaattctccattcctatctccgaaacatgggacgaggctcgcgatagggctgtgcaaaacactgtcgttcgtgttcgaggtccgcgaaacgcaaaggcggatgcgtgtctttgccgctttcttgggttgttggtatttcttggcttatttggggtcagatttatgtcctcgtctccttctgcaaaactcacttgaaaatcatttgtaagctgatatgttgttttgggcccctattccaaacttagtggggcctcatttttggctttttgtgtttttgaggtgcactttttttgggagtggtccaattaagctccgttgggaccaaaacagatagggattgcttttgtgtacataatactattccctacctgacatcaccactcgaggataaggaggtcattggggtggttggatcaatcttcagatacgtgatacggacactacgagcttcatatacacccacacgcattaattcgcccgacaaataacgccagccgcacactaatacgcaagacactccacaagacgccatgggatgcacgagttcgaaggaggtcaagcctggacctagcggaccctccgcaacggcagggaaggcgaaaccagctaatacggcgtcaaattcgacagcaaacacgaattccgccgccaccgcaaatgcaaacgcaaccagcacggccaacaacacaactacaaccccgaacagcgcaccaaaggccagagctggtgcaaacgacgccactaacgacaccgccaacacgccagatgaagagaaggaagtgaagacgcttctgctgggttccggagagtccggaaagtccaccatcatcaagcagatgaaaatcatccaccagaatggctacacagactccgagctctatctgttcaagagcaccatctataagaacctgttggattgcggtcgggctctgctggccgccgttgataagtttggactgcaggaggagcttgctgccgaggttggccacagcaacaagacagaggccatggaggccaacgattttgactttgtggaagacaaggtcaatgaggcagagcacccagtctacacaggtggtagaggaggcgtggagcagttccagatcatcttggacacccccaaccccaatgataacaacaccagcctgagcccagagctggtggatgctttggatgcactgtggaagactgcggtcgtgcaggagaagcttctcaagggtctgcgaaaccagttctacctgatggactcgggcccctactttttccacaacctacagcgtctcggaggagcccagtacatacccactcaggacgatattctgcgagcccgaataaaaactactggtatctatgagaccaaattccgactgggctcgcatttgattcacatgtacgatgtgggaggacaacggtcagaacgaaaaaaatggattcactgctttgagaatgtcaccttgatcatcttctgtgtggctctgtccgagtacgaccaggttctgttggaggaaaagaaggagaacagaatgaacgaatcgttggttctgttcgactcgatcatcaactcacgttggtttgtacgaacttctgtcgttctcttcctgaacaagattgatgtcttcaccgaaaaacttcctctttcgcccctagagaaccagttccctgattacatgggcggaaacgacatcaacaagggtgccaagtacatcttgtggcgttttacccaaatgaaccgggctggactcaacatataccctcatttgactcaggccactgacacctccaacattcgactggtgtttgctgccatcaaagagaccatcctgcagaacgctctccaggacgccggtatcctgacttgatgttgacattgactgtacagtaccatttataacttccattattactaatttgtatatatatatattgatgatgtaacgtagaaccgtatgtataacagccaggtgaactggaggcagagagcacaaatttgctacgcggatcttggaaaaaacaacctttcaacagtagaacaatggtttattacatcacaaatgtattggttctcgaagtaagtatcagcgctatggattttgatgaattcgttcacttttcccattcttcccacatttcttcttcataggtcgtcaccttcgggccagcaacaccaggtgtacaaaaactggtcccaccagttctttgtttcccctttcgttatcggggcatctgtttggggtctggcagtatcaaaatcgggtgtgggtgatctttctcgggtctgtccagcaattggagctctagaatagggatgaacagctcctggaacgtatccatgatgggatcttccacgatttagtcgtcgtgggatatgcttactctccatttctgcctgttgaggtgtcaacggagtgagtgttggtgtctcaaaaaccggcatccgaggggacgaggtatcgaatacagggttgaagggaccaatagcgcttggaatgaacttgtttcggatctcacctccatcaatttgttcaggagattcagagcgtgatgactccgtttcaatttggtcactaatctcatgtgaagccatgtatagctcaaggccgttgtccactttggagaaacttcgcttgcgtccctcatattgggctccatgtagggccactgggccagagactcctgcacccacccaccccatcatgtatgtgtaatctgcagctgtctggggtgtcagttgtcggtatcctgcaacgacctccttggcattaggcaacgttgtggtatcatcgttttgactctggctgttatactggctgctctcgttagagatggctgcctgtggggctatcatggcagccacatttgtagatacgtcgatcacttcttcggtatccatagttgacgtggaggtatctgtggagttgtttggggatcttgagaagggggaatcttgggtttggcgattggttgagccgacggtaacatttgaggtgttttcttcgatggatatcacaactgggtcaggttttagcgacattttcagcgacagttagcaatgagtagcagacagcgatggtggttgtttaggtgaatatcatcatgttgagcttatattgacattctgtgtgtgtgcacaaaaagttgattacaaaggagatttatattgatctttcgaccagaacgatcaccaagactgcaagaaacgaacattacaatgaaaaaaaaaaatgtacgcccatacgccctaatccattcccatgcatttttctacttgttactccttcagggtcagcatgtagccaaacaccattgatcgcagctccttggtctcctcctcctcctcgaacatagggtagtacttgagctcaaacagtttctcgctctcaaatccagcttcatcctttgctcgtcggaaaaagtccagatcctcgttgaagagcttggctctgtggggagtgaacacaacgaacacctttcctccgggggccaacagctccttggcagatcgcacaagcttagcatgctcagagtggttgaagacgacatctgaaagaatgaccaggtcgtaaccagtgccacccgacatctcaatgagctcagaagcatcgtttccccaaatgaaaccttcgaccttcatggatgagacgtcagcgcaaggggaagggccagagaagtcggcattcttggcatcccagtccttcttcagctggtcaacgttgtatttgaggttgtaaagcaggtcagcatcagggtagtcagtgatcacaacctgcttagcaccaacggcgtggcacagaagagacggtagtccggctccagctccgaactcaatgaccttcttaccctcaaccagctccttggagtgctcatcaaggtagtcagaagtcaccttgccagcattccacagcaagtgaccccacagagggttcttagcggtaagacgcaagttgaagttggtgggctctttgtactcggaggcagccacgtgtttttcttgacgggcataactgtcgctgccaggctgctcctcgggcttgtaaaagtccttgggctcgtcaaaaaggcctccggaggcgagatcttcaatgtcagacatgtcagtcagtaatttttcggtggtttcaaaatttcaaaatttagacttcagatcaggttatgatgaaaagcataggttaagagtactttccagctacagtacgctgaacgaggttatgactccgtttagtctggtttcgtagctgaaaaaaaataccctactggcttgagaccaacgttagcacacacgtcacagtaggactgaggggtttctgtctaggtgggggagattgcaaacattggcagtcgtattattataatattttgagataatttcgtttcatgtcatttaattcgttccatttgattgcctttcctgaaaagaattgtaaattcggacaatcgtattgttaaacgcttgcatgcatcgattgtagaacaactctgtgccatggttacagataaatctggtttgtcacggtgcaatatggttcttggtgatgttggtggtggtttgagtgagcagaagcctgacaacgtgtgcggagaccccataatcgggtggtgcctcatttctgagataataaatgtatttagggggactattaggagtgacacaattaagggcgagaggggcatgtttaatccggcatttattttcatttattcgtgtgtaatttcaccatcacgtgtgcttagtcagaaccttcagtatcaccccacattggaccatgcagcccacaagtggagtttgctgcttggggtggcccctgcctccagaggtgcaatttcccacatgggctggcccacgctaatgctatggtaacatcaggctgtggaatcaaaaatcgggaaaaacatccataaaaagagtgtaagcagtatcttttttacgcgcatttttccgcaataatatattatccgcctgaccttgcacactcgtttttttgggcgtctccaaatccggcgaatataccaaccttagtggcgttttcaaactcagactaggttcggggcggaaatgagaccggaagagtgtgtgatgtgcgtgaagatgggaaatgtgcgagatatatgaggacaggtgagattgacggcataagtcatatccggctcctggctgaaaacggtatgtggtgtggcatcttagcgcggtgtaacagtgacaatgcagtagtgcacatcctgtaagtgcaagttgtgcaacaatggcaaggcacatacgggtcagagagaccgatacgaggcaagcgaaaaaggctacagtaatataatatggtcagtgaaaagccgaccggacacaaagcacaacacgccagcagcatcatcctaactttttagtccgacagccactgcgatctcacttttctaccacatcgcaaccacacattggcgacctccacctaaactctatcttcctggtctacgctatcactttcttttgacatcacgacaacatcaaaacctcataaatccctccccagcacccacaccgcaatgccaaaatcgaaaaagatgctcattgcacccacttcggcctatctaggtcgagacagagcagttacccccactgcagacttcgacgcggcgtccccaccgaccccagcaccttcgcctacaccgtcataccgagtgtcacaaaacggcgagtcacggtcgacgaacacgccaggtgacggactacgacaactcattacaacctttgacaaagtctactctcgactgtcgcatgaacacaagcagcgcttctttgatcacattctttccaaatcgcaccaccaggaactgtcgtatctcagcgaggccgttgttcctctgctgaagcgagaccccttcagaatgctaccctatgagatttcgctgcgaatcctcagctacgttgacgaccctaagacactcggtaaggcaagtcaggtcagtcggctgtggcatctgattctgagcgacgaccagacgtggaaaaccctgtgtgaacgacaccagtacagacgtctcagtgccgctcaacgcatcacttacaggcagagcagtcgtcttgctagtatacccaacgtgccggagaatatggaggtggactccaacgtgctcgagtccatgtacgatcctgagccacttcgacaggttcctctgagctaccggtcgcactttaaacaccagtacttagtagatgctgcatgtaacaagggaggaagactcgcagcgaaacatgtgacgtctgaccaggctgtggttacatctctggagatgaatggtcgatacattgtggttgcgctggacaactcgcgcatctacgtctttgccgaagacggccgtttgatacacacgctgttcggtcacgtcatgggagtgtgggctatcacagttctgggagatacgctcgtcagtggaggatgtgacagagatgtacgagtgtggaatctcaagaccggcgagtgtttgcagattctacggggacattcgtcaacggtaagatgcctcaagatggtggacgagcgaacagccatttctggttcacgtgacaacacgttacgtgtgtgggacatccgatctggtgtgtgccttcgtgagttgattggtcacgacctatcggtacgatgcatcgaggtggtgggtgacatctgtgtttcaggaagctacgatttcaaggccaaggtgtggcgaatctctacaggcgagtgtctgcacacactcgagggccactactcgcagatttactcgctcgcgtttgatggaaagcgtattgcaacgggctctctggacaccagtgtgcgtatctgggacgccgccacaggaaatctgatatttgtgttgcagggacacacctctctggtcgggcagctgcagatgaaggacaacacgctggtcactggtggctcagacggtgccatcagggtgtgggatctcgaacaaggagcttgcactcagcgacttgctgcacacgatgggtctgtgacctcgttgcagttctctgacaacagaattgtgtctggaggctctgatgggcgtgtgcgagtgtgggacatggcatcaggtcagtacattcgagatctcagccaggcgtttgactcggtgtggcgggtggcattcaaggaggaaaaggttgtaattctggcgagccaacgtcgacagattcacatggagctcatcagcttcagccctaaaggtgaagacaaggaggttgaccctttggaggatggcgtggtggtggaagacattgttatggaagaggacgaattcaagtagtgcccagcagacgttaagatatacataatatatttgtatattggaataggatgtcagagtctctatttttatatatatactcctttttttttgcttctcagattgccgcaattgtccttcatcccagagtgtgcctaaaccggtgaaccctaaggcgccgcaataaacaattttaatctgcactggtccaaataagattcatcagaacggcgggccacatcaatcgcatcagcacccgacttaatggctctcatcaatatccgacgaatttttgcgtcttttcgaaccgacgaggaagagcgagagtattcacgaaaggcgttctattacctgcttggttttctcggttcctgtgcattttcttctctggtggcgcaacgactgagcggagttggaaactaagacgcaagaaaaaatcgacatcaaaacaacgtgatatctgcccatgagtggatttgttagaagtggagggtcttttggtcgcgtgtggggcaaatcaagcccaggggtggccgctccaagcctccccaagtacggagatcggctggaatcatatgatttcagaaacaggccatggctccagagggataggagcggactgtttcctttaatggcggaagagaaaactgaagagggatatctgcgtatttcgccactgcagctcaaggcgctaaagaatccaggcagcaacagggtcagtgtgacagcagctagtgcccccttctgtgaagtgcgcacgttgtatgagctggcagaagtggctgtggaggaagaaaaacccactaatgctatggaaaggggagctcaagtccacaacatggctgaatatagtctgtacgaggctacagaggtgtctttacctgtccctccagctacaactcccacagaggagtggtaccagaagctgatgaacatgtacctgaagctcagcatgttgagaaccgattctgctccagcggtcaatgaacttgagatgagccccacatttatggctcgtgagatcccggtctttggcaactacaaaaatacacgtctgtttggaattatggatttgatttattggaggaacaagaagctcaacatttgtgatatgaagaccacatatcgtcgttcggtccctgaggagccccagatgacgtcacacattcaccagacaatgctgtatcactacttgttcagtgacatgtgtcgtgatattgacgccactatgggcgagtatctgcgagacgacatttgcattgatacagatgtgcggtctgagttttctgcggcttatgagggtcagagtggaccagccgacacaatcccgacttcgatatctgggttgatcaagctgattggcgacgagctgcctaagccccggtctctagcgaaaaccgtgtctgtagagtacgtgaagcgatcggaagatcgagtgcctgaggagtaccaggatctctacccactctcggattacacccaacgacagtcttttgccgtggttcaagcccctgttgactacaaggagctcaagcgggtcatgtctgagacactgcccttctggcatggtcagcgggcggctatcggtgtggatgcagacagcatgaacaaatgccggtactgtcaatttcgacctgtttgtgggtggtacaactgaaatgggggtggtggtgatgggttaaggcgagacagatagattggaacacgatttgagactctcagcggtgcccaagtgggctgtggaatcgcatatagtgtagtctgctgtgtaggcgtcgtgggtgtagtgggcgccgtagaggtggcaaacatgataggtcctgtgggtgtctttggcggcgtgtccagcttgctctgctctatggatgttgtagtgaaacatgaggtatcgatcttcaaaactggccgctgtgatatggtcatttttatcgcgtgacgttccatctacagtaacatgtttcctccctggtctttaaatatatctttagacaactacacttgtaattggggctggtggtgaggcaggcagagaattggggaatatgtggaaacgacgcggggaaagttctgaacatttacaaatctgatgatatctagaaaccttcgacttcttaataaatctccatcttcttctcggattctgtctatttgatacgtcctgtttttgttcgatgcgttctctccatcaccactgttgacatcctcatcatggcccactattttccctttttttatataccccgcccaggtgtggcccgaagtttagttaaactattttagccatgttctttgttaaactaaaccttgttgctgtgtaactagttacatggagacaaccaaatgggctattcgagaagcctcaatagaagtatagggaatgttgtggagatcttggggccgtattgttaacatgaacctgggggcggctgtttgtgaaactgttcttgaaatgttacgaacccttgcagctctcgacaacactaagcacacctcgtatcagtgtacagaaccctctctgataatgatcaagcttttgggagggtgatgatgttacgcgatgagatggtcttttggaaattatttcttgctgttacttgtacaagttgtacatgttctacgtacaagtgttaatacacagtacagcctagtatgtacttcgagtggcgacgttcttgctgaacttgttttaacgggctactcatattgattatgtaagcccaaaagtggggactcattttgggtatacctaaccctgcaccttatccaaactcaatacgtagtaccaaacatggatggacttgtaataactcaacacacacattaatgtcgacagagtggacgtcgtacctgaagaaggcggtggcgactgcggagagcaggttcgaccaattgcttgaggaaacgtcacagggctctcagagctcccaactccaaagcccacagccaagcagcactccagatctaaccaaagatgtgaaagcaaccccctctccgcgactgagtatgcaagagagattgagaggggccgtgagtgcgagtccaaggagctccggtgaattggagcgtgagacggactcagactctgtcagcatcaaggacgacgccaagggagcagaggacgtggataaactggataccccgccaactgattcgaacacgtctatgcccccagaatccaggggagctaaggagcttgtatctgagtctgtatctgttgtagattcggacctactttcgaagatccagaccgaaaacgcgacaatggctgaacagcttgactcgttgcaaaacaaggtggtacttctggcaggactggaggctgagcggaccaaaaacagccctgcaagcgccaagaaactcgcggagaaggacaagcaaattgctttgcttattgaggagggcacaaacctgtctaagaaagaacttacttacatgaacacgataaagaagctccgggtcaaggtcaagcagggtgagactttgcaggagggatttgacaagattaaagcgcgacaagacaaggagctggggactgtcaaggagaaactgaggagcaaggaatctgagttgatgagtctgaaggaggaggtgaaaattctgaagaagaacgtctcacaatcggggaagttggacaatcccgagttgagggtggagctggaggacctcaagaagtctcgcgacgccttaaagaaggaaaattcagagctatccaatgatctagaggaggtgaaaaagtctcgtgatacactgcaaagatctcgagagacccttcaggcatcccatacgactcttcaggagacccacgaccagctgaaaaacactctgaacacatcctctctgtcatcccagacgttgattgctgatctcaagctcgaaatctctcgtctcgagacacgtgtagagcactacagagggctgaacgaagaggctactgcccgcaactcggatgagaatactgctaaactgcttaaccagattgagaatctcaactcgcagcactctcattctcaggacaactggcgaagtgtggagctttcgttacagggcaagatttcaaagctcgaggaggaagtggaggagtgcaagtcgcgtgaggctgccttgatgaagaaaaacaaggcattgcagaatgatctgcgtgctgagagagaagaaattgctaatctccaagacgagctaggagctgtcaatgagcagatcttcaagagcaaacgacaggttgagacactacgagaagagctgaaggaatgtttagctaatgagaaagatgacattcctgtatctgaacctgtttcggtgccttccattgctaagtcccaacacgctgaagaaatggagaagcttactctcaagattgcggcattagaagagcagcttgaggagcgaaacatgcgtcttgctgctcgtgatgaagcagatatggcagtgacatctcctctggaggcagagtctccttttgggggtgttcccacatctccttctgacacttttgaccgctctttctcttacgatcgctctttcggctcatttgaacggctgcaagatgtcgatcagttaactgagctagactcgcgacggtctggaactggtccctctatccaagtcatcggaagaatgagttctcaagtgcgaaaactcacgtccgaagtcagtaacctcaaagaggaattggtgcgggtggtcggagaaaaggacgaggcctcgcgtgaagtggtgaggctgatgaccgaaaacgatgacttgttggagtccaaaatcaagctggatgcggtggagggaagactagatgcgatggaaaaacgtgaatctcaagctctgggtatgctcggcgaaaaggaggaaaagatcaacgagctgagagcagatatcgcagacatgaaggagctttactcaaggcagatcagcgatctggttgaccagttggtggaggcgaagaagtagtaatgtttgtagatatataacgataatcatgtttccaaaatgtgcacagtcttccgtttatacagctcctgaatctacatctgcaaggatcggcgctatcgtcctggtctgagttagttatctgtgtaattacaagtgtatgtacaggaattatgtcgagtatgtacagtacaagtggctacaggacttgtacttgtagtatcgtacagtatgtacagtgagatctgggtaacatttccagtgataccagagagacgtctaaagaagggacttattttcagacgttacagtattcaatcaatgcattcaacaagtaaagtagatgaacaaacatctttcacatcacctttttgatatcagtgagcattctcactccttcctgatacataacatcgtgcttcatatctttgcccatttcttcagctctgttgatgatagcttggggaataccagctagtccagccacgtttagaccatagctgtctgtggcactgccaggcttcatcttgtatgtgaaaatgggagggttggtgttggtaatatccatgtgcacgaggtcgcacttattgctatcttcactatcaagcaactgacctaggggataatgagtaataaataatgtcaatgcttcaagctcgatgaaatgtttcagtacagaatgagcaatcgcgataccatctgtagtggtggttcctcggccaatctcatccagtaatactagagatttgctggtagcattcctgagaatctctgcacattcacacaactccaccatgaaggtagattggccactcataatgttatcctgagcccccatacgacacaggatagagtctgtgataggaatctgggccttcgaggcaggcacgtagcacccgatatgtgccaggagaactgatagagcgatctgtcggaccaaacttgacttacctcccatgttagggcctgtaacgacggtagggcatctaattttgatgtcattggagatgtaattggtcatcagcttctcggtgattacgtggcgggaatccttcaagtcaataccaccttcgtcgacgtagtctgccttgacccaccccgactgtccactgaccttagccaatgcaaataggcagtcgaattgagacatggctacaaccatagatctgaagaactcatagtgggtggcacaccgcgaccggaacatgttgaactcgatatcgcaggcagccttgagtttctccacgcagtattcgtgcctcttaactagactgttgagcgtgggtgtcctgaatcgtgacacagactttgtgccactaatcttcgtccattcaagaggtagcttcttggtgtccttgtttgcaacttcaatcaagtaatcaataccagccacggaagagtattgcagcttggggcggttgagttccgctcggagtgctagcaactcaatttgaagctcggcttccactttcttaaggtctttcttgcgatctaccaagctcggggggtcggtcacaaagaacgtgagagcctcgtcttgtcgcgctgcatcagggttaatctcctccagaagtttctcaatatcactcacgtgaatacccagagaattaaaaatttcacctaacacagggttggtgtcgatgtacttgtcgccactgccaggcttgaactcttgggcaacaaacaacagttcccgaagcagtaaatacacctcctttctgttgagctgaccgtagtggagtctcatgagcatcttgctaaggtcaggaataggtttgaggagcttcaccaacttgttgatcaacgtggtcagctcgtctgattcagctccatatatgcttttgatgatagcttccaccgcactaagtcgttgaagaatcgcagttctgtcggtaagaggccgcgatacccacttcttgagctcacggctgccgaaaacagtaagacatctgttcagaacccagaataatgaacccttagctgtgtgatctgtggtattagcaaacagctccaaggatgccactgtattggccgagaggcgcatgtagctgcctgtgtatctagtgaagttgtttgtcaacaaaaagagtgagtcgagcttacaatgggtaaggtagcgcgaagtagcgaggatcagtgttttcaccatggcaggtagttccagaacagtagaacaagtacctgcatttgcttttccctcaaagaacagtgcgacctgggcatctggatcttccacttcctcctcaagaacattcatctcagccagtcgacccttgttccgatgcatatacttctggcacattttgagcgtactcgagctaacgccgcagttcaaaatttcgcatggtgctaacgtcaaaagccttatctcgagttcggactttacgtagtcatcattgaacgagtcccagatgacgtcaccagtagacacctccgtagcgagcaatgtgacagtaggcttgtcccccttgctctcgtgcaatgccactaagtacgaggagtactgcacatcattcacactgcccccatttccactctcgatatatgttcccttagtgaacgtgttggtgagttctctgatcataggtccctttttgttctcaacattcttcaatgctgccacctccatctgctgcacatggcccaccttgaatcccttctcaaccagttgtttcgtgtaaaagtcgattctgtgcactggaaacgaggagtaggctagcttgatgtacttgctgccttgttggactactccatcgtttccgatatccttcaggtttgtgatacctggactgaggaataggcgtgtttgggcgtgagcaatttctgcgtcatcgccgtagatatggtatttgtagcccacctgcacaaacaacaatgtgtctcgatgctgcttcttgatttcgtaccactggaactctgtagcgttcagcttcgtctttttcgtaatcactggcaagtcttcatcattcttgtttctaactagctcgagcttcgctctgaacttctgcttgagctcagggttgtgatcagtgttaattgacttgccgctcttgaaactcgccaaggattttggacgagacttggagttgatttcagatccaattgataaatcaggctgcgtgtccatggcaacgacgtctgtcgttactgtcaccggctccaggggcggctcatctgtgacttgctgaggtgatttggcgtccttttgctcagctggagaaccagagtctgtaggttttttgccgatcaccgcttcggtgtgcacagcgtcggcccctgttttgggcttcttgaaaaatcgactcagtgtcgcttgtttcgatcgtttcatgatgatgataattttgatctggaaaaagacacgtccgtacagtaattaaccaatttgttggatttaaggtttcgattggtgaagtgctgaacactctacttgtagcttgataaaccccacgaggaaactaatataagatgctggaattggcttgaggcattggtataattagtggcacagactctactcttctcagtcccctacttctttaaccgtagttggagagctgatcgtctttatgggctgggacctaacccatctgcacaccaactcaaaaacgcgtcgcgatttatttcggcttttttccgtatcaacttttcaacccaacatgctgggagacacggccctcaaactggtgcacgattcgcgccgaactgctgcccttgatttgcttccagcgtatcaggaagagctggttcgtggtgtgtgccgagaaattcgccaactggatgcctccatcaacaagacacaggatgaaccgggatacgacccacaagatcgagtggcccattgcaacctcctggtacagcatctcgccatgcgacgagacaaacgctgcttgttggcatatcaattcacgcgtgcccggcgtatgaatgaagccgcatggaaacagacggaggaaccaaacctcaacggtaatgagcaggagtacatgaaggcgtatgaggatctcattgttgacatcaagggcccgtacaccgatatcgatctgacaggatcattggagcctcccaacgatgtgttcattgatgttagagtgttgcaaagcgtgggcgaggtacaaactgaatacggagtgttcaaccttgagaaagattcgcaattttttgttcggcgaagtgatgtccagacattgttacttcagggctacttgaaagagatttagatgcggggacgtggggggttggattatttatggcttgttcgtttgcatgaaggatgagtgtctgcacatgtatttcactaatgattattttattatttttactgcaacgcacaaactgcgtatcactggtgtctgccactacaagtatgtactgtatcctctcatttcaaaaatctcgtttatgacttgagcatatatggacataatgtagctctttcgccgaagatgatcttactgtgggtacaacatgtactgtaagtaacatccaagcgtccaatccttttttgtacttgtaatgttatcaatccataagttcacaacgattaagttcagaaaaacctccgcatcctgactaatacttcttctaataagaagcaaatagcaaatacgtagctttattggttcctttccttgctgatgcctcctattgcggccaatgagtcgacttcgtccatctcctacagcatacgttgtcttagatgtatgtatgtagcctccgccacccgtaacgtgtacttgtagcaagaagctacccatttctatccgtcctctatactacaagtactgtgtgtactgtatgtactgttatgtactcatatgtacatacagtacttatagaagtgtcattaatctaagagaccactctcgtacaagtactactacaatacgtcgtaaaaaatggggtggatacaacggcaatcatcagtgaaacaacctttaagacagatttccacatcatgattggtacacgctgttgaggttcgggcagctacaagtgggctaacatggcagactaaatatgccgtaccagtagcaggtggctcgttgggactcattaaaaccatcttggcacttcaaatatgcacaggaatcctgtagctaactactgtacagtagtgactcgggtgactctgtacggagctatttatgaattgtgtgactcggatgactcggatgactcgtctcgtgcattttcggccgcctggggttacaaagacccacaaatggtccgtccacacctatggagttgtgattgcagactctgactcttactgtcttgagtccttactactttgcaagtactcgtactactaattagctacttgtagcttcttgtagcagccgcaagaacatacttttgagagccactcgattggagtcaagggacccactcagtgtgcaccgcgagatagcaatcggcgcactgacggaggcagaaggtgacaccgaggggtagtcgtaagtttcatcacgttgggcattagattcatattgaacttaggttacacgatttccggggattcctttggtttctttccgggggattctttgtggtcaacagttcgtgcctaaattagacttttcatagagtcaattgaagactcaagagtttagagcggagagagccagaggcacaaaagacaacgctcagaagacctctggggtgtaaacatgccgtaaggcacttatcagattgatttagggtactgttctacgtttttttacctgtctctgagctctcgagtcgatatctatggggctaccctattttgacatgactcctccaacgcaccaaatctgcacacaaatgactcaacatgattggggcgactcagtagggcgactcgctgcgagtcagacagtgcaggagataacattgagaaggagagcgtcgataagacgtacaatgctcgactcgaaaaagacacagcagtgacccaaattcaacaggggaaatgttgaattgaagtttggcattaattgagctatttcgaggccctctgacatatattgaacgcttctttctactatcatgcgcaaacccaatcaatcttgtcgttgacttctggatgagggggatctagactgtaaggctagagcttaatgtctaccaacaaccgtccaagactctagccgctattagggcaccagtcaccattcactactgtgcttcaattggattgtttccaaaccgtgcgtgccatggtgtcggttctaaaccagtaccctgttagataaacagcgtacaagccattgtttagtccaagccatagccagtgactttgcttaactcgactcattttgaactttagcgcaactctactgcatcccttttggtggcctgccgtaaatcacatactgtcggctgcgctgtaaaagtatttaaacagggctggatccccttgttacgtccacacacccttccccttatatcacctacaattaacatggccccacctcctgctgtcgttgcccaccccctctcctctcaggctactggtcttgatatggtccatgagttcaaccagaagctcactaagtctgatgagcacacttgggagtctttcaagttcgcccccatccgtgagtccactgtctctcgagctatgactcgacgatactttgaggatcttgacaagtacgctgagtctgatgttgttatcattggagctggctcctgtggtctctctgctgcctatgttcttgccaagagccgacccgacctcaagattgccatcgttgaggctggtgttgctcccggaggaggtgcttggcttggaggacagctcttctctgccatggttatgcgaaagcctgccgagcagttccttgaagagatcggtgtcccttacgaagatgagggagactacgtcgttgttaagcacgctgcccttttcacctctactctcatgagccaggtgctcaagttccccaatgttaagctcttcaacgctactgccgttgaggacctcattacccgaaaggatgcccagggcaaccttcgaattgcaggtgtcgtcaccaactggaccctagtttccatgcaccatgatgaccagtcctgtatggaccccaacaccatcaatgctcctatcatcatctccaccactggtcatgacggcccattcggtgccttctctgtcaagcgacttgtctccatgaacgccattgagaagctaggtggcatgcgaggtcttgacatgggccttgctgaggatgctattgttaagcgaacccgagagatcgtccccggcctggttgtcggtggtatggagctgtctgaggttgacggtgccaaccgaatgggtcccactttcggtgctatggccctcagtggagtcaaggctgctgagactgttcttgaggtgtttgatactcgaaagaagcagaaccaggagtaatctataacgaagaataaattgatttatgatatatatatatatatatatatatatatattaccctgtatcgaatcttgctcgcagacactgtagaatgtataagaagcagcagcatactaattacttgtacttgtaaccagtcagaccgcatctcggtggcaaataccattgcaaaatattttgcacgtcatgtacagttattttctatggctctgtatataccgcctatcccatgttcatagtgtttccactacccttggggttcgcctccacaaactcatcccattcccgtgccttcattgtttccctgtctgcggcttcgtcatccatgtcattgtcgctcttttcagtagaaggaatttctcctcctccttcgatgattcctcctcgtcgtttctcttcctccagataatcctcaacagacatggtggggagatattgacctgttccacgcaccttgctctgtagctgctgacgagtgctcaccaatttaaacggtctgtttattttgcccattgaatcgagaataggtcgacctgcctcagtgagaggattcttctcaagcttgtcagtgtagcctgtcacgtcctctatctgtctctctcgcccatcctgatcctgttcagcctgcgcacgtctcatcagatcgatgggaggctcaggcctgctgggtgctcttgctagcatttgaacctccatgctgagcatctcaagtgtattcaaggatttcagagtatagagcttcagctcctcctttctcaagtctctgacttcatcttcgtcgacattcggcgcatctggatctttctgcttggcctcaattttctgaagcaaattcagttttccttccagttccttctcggccttgtgtttggcaatcttctcagctcggaaaacggcggcgtcagtgggtcgcagttgatctgagagctccttcaccttggatgcgacgttttcgatggttagctggcccgccagaaatgactccagacgagaggcatgtgttttaggtagcaggccgtaatggtcgagcgatttgagaaagtcattgtaactcttgacttggtggtacaccagatttttgcgatcttcggcaccttgtactcgtacccgttccagcgccagagccttgtgataagggattgtcaggtaaacgatttcatttgtttttaggtcctcccaggactcgttgtctgagaagatgcccaaagacgagatcattttagagcattgatccagtgattctagcacctccttgacttgcaattggtactcttcggagacaaatgggtgactggatcgtttcaaggtatcgattagatccaatgagtgttggaattcctccttcagtgttcgagacattatgtgataatggtgaaccggttgtcttgtccgccttgatatttcctgagactatgcatgattgtgtaagggcgaggctatccgtgggttcaattcctgagtatgtacatttttctatttttcagtaggaccacatgaactcaaagaagaaaaaaacatgcttatgtcatacggatatttagtggcatgcaccaaagataccatgcaagggggggcggtgttgagaccctttgaggggcaatcgataccctgccacaacaaatcacatgtacttgttgctgatggtcggagctcgaccgtttctgtgagcactcctcctaattataactaaccaggtgcgggcatcctgagctaagggtgagcatgctgcttgtgttgatatcattgtttggatgcaagttctgtacaatggaaaggagccacatgggccggtatcggtgtcctgcaaatattccgtggggtcacgtgatggccacttgatgccacgtttcactaattccgtatttgtgcataggctctctctaatgacgtcattcaacttgtgcatgtagatcagggagactgcacaatgtactcgtatgtacttgtatgactcctctgaacatccacatccagtttatcacctgggatggggactttgcactcttccagggctctatctcgttaagtaggtttctgttttgactgaaagtgaaccagtaacatcgaagtttcagaagtgggtggatataactcacgcatctcacctacgaatactctacagtaaggttatttgtacagaggagtgaaagataggaagaccgtatataataatacgcctcttgtttgaaaaaggagcaaagacagggcgtgcgagaatgaccaactgtatccaccctgtggtggtggatctacgtttatgctattgcaattgagtgtacaagttcctgtatatgatgcgcggttgtattgctctatcatttgtgaacacagatccagcagtaggccaaaaaatacagtacaagtactgtactggcacagtatagactctacattgtggttaaaaaatgaccctccacttgtaccgacagtatgtactgtactcatacttgtaacattgctaatcacatgactttccaaagttctacgttgttccatgaacccaatcctggaagttggttagtgagtgaaatagtggccgcggttgtaccaataacaaggtttgctttgcaccatggaactgagcaggttcacgcgctcaattggacaccaataactaacagaaatgtctacgtttataatccctcggttcgttgaggtgtgcccaacaagtgctagaaacaacagatgcaacccccccacaaagccctaactgtgtcagtgacgcttcgggaataaaatggcacgttcatgattactgtacctatggtttactgttaagaacactccagtccgtgtcatcttgtctgtttaccacgttgcacctctcacttcctacacgtcccaaacgtcttcatgtcaacccaaaaacaacgtgcacctccaacgtcagatttcgtcatagggttccctttccaacaacgcaggtaacgttaatcaggataaactgtgtgcggtctatagcgctgtgtaaccaaaacgacacatataaaagagcaactcccgcccaccctcactgctcaattgactctaaacagaaacaaaaaaatgtctactgtctccactaccgatttcaagcaccctcaggtctacctgaacaacgacaagaactcctttgcatacacctcttctcgggatcgatggcctcacatcctcactggtgtcattgacgatgttcacaagaccattgccgagacccccgagggagagaagcgagatgagctcaagaaggtcctcgagcaaatcaccgctctcaagcacgatgttgagcacgacaagcccctgaaggagcttcccaacgttgccgacgacatccccgtttacaaccgtctgcttaaggagaaccctacttcctggcttcagggcggatgggtctttgttgagtgctacctctaccgagagctccaggtctactttgatcagaccaagaactggaagacttacgacatcttcagccgtcagaaggaggatgctttcaaggcctcttctgctggtgtctccgagctcgctacgcggtacaaggcccttgctgagcagcttaacggcgtctctgacgaggccaccctcaaggagctcttcaaggagttctctgatatctctctctggggtaacgctactgatctttctctgctgacaaccatgtctcttgaggaaatcaagaacctccagggagctgatgtccgaaagaagaacgaggagaagattctcgtcaaccacattgagaaggcttgggacgttctgtacgctgactctaagcagaacgatggctctcgagtagacattattctcgataacgccggctttgagctttatgccgacctgtctcttgtcctcttcctgcttgactcgaagcttgccaagaacgtcattctccaccctaagaatatcccctggttcgtttctgatgttcttcccatcgatcttgtgaagaccatcaactacctcaaggactcctccttcttccccgaaggccgagagcagattgactactttgtctctaagcttcagggataccttgatgatggctctctgtctgtcagaacctcagccttctggaccaccccccacttcttctgggatatctatcctcagggtatcgatggtggctcccaggtctgggaggacatcaaggattccgctctggttatcctcaagggtgatctcaactaccgaaagctcacttgtgatgctgagtggcctcgagacacgtctttccacaccgcactcggtccccttggagtccacgatgttcatattctgtctttccgaacttgcaaggcagatgttgttgttggcctcaagcctggtcaggataagcagctcgagaaggagtgggtcgagcagggcaactccaaccctctgtcttggtgctggtctggcaagtacgccgtcatcgaattcaacgacggtaagaagcagtaaacaagttatagaagtattatagattatagacaaccccgagtgagggatttttgacaattgattgacttgtagttcggagaagctaagaagtaccggtgcactgcaattgtattcatagttatacgagtacatactgtatggtacagttacaagaacgtaccgatggtgtataggacgggtatgtattcgtatcgtatgtcaactgtatacgaaatatccgcattacgaggtcattgggtcgtatgaactcctgacacaccgacgcgggtgtcactgtaggaggcatcccatttgacgtacatactaagccaactggctccctagtgttcactaggaaatacgcacaacaaacacgcacacgattatattatatttatatctcggccacaggccacctcccttgcccaccaacatcgcaatccacacataattgatacacactacaacaagtaagggttccttgactagaataacccaaaactccatataaattacatgcaatatacaaaacaatgctgttttgaagatcatcgacggtcatcgtatcttctcttctggttcatctgctgtcgtctcgcacccttgtccatgaactggccattggtgactccattggggttagccacaaacgtctggccgccagaagcaccacccatgggcatattgggcattggtggcacaggcatacccatctttcgcatctgctccatctgcttcatgaagaatggcatcatctgtggagggatgaaaggcatctggggcattcctgcgggtcctgttggtgcattgggaggagccgaggaaccagcctgggaaacagcagaaccatcctcggttttggttcgctttgcatcgggctcttccttcttttgctctttcttaatatgctctttcactctcttctccatttccttgtcggggtgaagctggtccaacagaatttcctcagcaccacacttggggcaaacaaagtcaccatccaacagtgcctgttgaatggcatcttctgagtacgtggtcttgcagcaaggagttgtgaccgggtggtcaaacagtttcttgcttagagggcataccagttcgggatcgatatcagcctttcgtttagccttggtatcttcaactgcatgtcgagcacgagccttttgcttttcccatgacttctgatctgctacctgcaccacatattcgccatcctcattgatcaagacagcagacttaccatcaagatcgtcctcgttgaggttgggcttagcaatagtcttgagaaatgacttgggaataccggtggttcgccgcattcgcattccctcccagttgggatcgttgttggtggggcagttccaaatgaaatggtccttcttaccgcacttatggcacatgtatccttccggcggagtatctccatactgggcctgagcagctgctgcctgggggttgttggagttggcagaaagaggctttccagaagaagagggtcggttgtagacaggggtttggtaggccatttgcttctgtgtttccttccactgttctccctgagcagcaaacatagcattgatgagatcatcttcggctcctccagtgccagtagatcctggtgttgctgatgttggttgcactacttcttgatcgtctcgtctgtagcgtgtgactggaggcgctccgttgacgtacctagcggcctcgcccttgcctggtcgagagggcagtcgtcgtgccagtacggaagaagatctggcaatcagctcgttgtcgtctctgtattcatccttcgtatcgggattgacaatagctagatcaaactgatccgcagatttgtccagcttgttagaagtgataatttcacgcttcagatcaaacacagagatggatgtgccgtcaaatacgaccttggacggctccttctgcgacttgaatttgtagtatacaaatgacatgctgcgatggagaggtaataaattgattagtagttgtgttggatgactggtgtggtgtgcacttcttcaagctctctaaaagtataatgaaaagtgtcgttgattatgtaacactgcaggtggcgtaaatacaggttttaaggcatcacagtgtttttgacattcgagccagtacatgtaccgaagttcaaacaacaagtactaggtgaggctttaagagctttgggctttaggatgttgaagagctacgatatggcacctcatcggtatactacataatctgttaccatggctcctatcgctcgatacgaagttcttcttatcgttgtgccacagtacttgaacgtacagttatttattatgccgacgtttacgacagggtaacccgtacccaaaccaaatttatgggataaatgattgtgctattataacgaaatttgtagaataattccgaattaccccttcagtgacctctctgggcacgcccttagcttacaatcccatgaagatggcaccgatattaagaacactaacatattagtcatcccataccacgtgcagtccattcatgcacgcgaagtacagtatttagtagcaactttggtacacttgtagctatcgtacaactatcgcacagtacaagtataaaaaaccaaaaaaaagtacaagttattgaagatcattttgttcttgtattgtacaatacatactgtatagcagcagcattaagtgggacgtcccagaggcttggacaagagccattctacactgtacttataagtacgagtatagtatgtagtatgtacttgtacagtatgtatgtacttctacttgtacgagtacagtaattggaacgtggtctaaagcagtggtcgcataatttttctgtcttttagcacggtggtcatgaagataatgcagattttgccacttctacagagaatctcacagcctgacatacatcgcccctgagactacaaaataggtatcgtacagtatgtcctgtgcacgcgtacaagtacagtactgtacttgcaagagttgtgtttgtccatcacgtgactcacataccggaaacgtaaccctaacccaaacacggacacgtaggctatcgtgtgggatgcataaaaaaacactgttcccacaaattcgttgatactgaaccggctctttggtgttcaccgaaaacaacaacaacaacaatggacgctatcacatctatgggatccagctcagtaagtatgagacccctgcgttttcgcatcccaacttttactaactacagctgtctggcctgtctgaacggttcaacctcgagcgactaagagtgagtatcatcaaggagatgggcatggtgaaattaatacgagactatcgcgaagtctcaaaaagagatggtattgagaataaacggaagcgttattgatgtacgttcaatgctgttgaaatttgtctcacaacgcgaccgtaatccaccgtgatgaggcttgcccaaatctgtgtggactgtgagacgaagatggtcatcccgtgctcgactctttgttgtaagcagaatgtgacgcacttaagcatatggcgctaaacctgagaatcctcagtgacgtgaagaagtctagagggtgcgcgactgtgagcgaccatcgaacacgtccttgagccagcgcgatgatagcgacccctacgtgtctcacgttattgaaaacattggtgtgcctctagtactctgaggtaccatcacccgcgagcatatggaggcgaagggaattctctggatctgcgctttctgagctttggactaacacagactgagggcgcgaatctccagaaccgatttgccaatctcaagtcccccaccgacttcttcgatttccgacgaatttccaagcccccgacctggggcgaagctcaagctcgaatcaacttcaacctgggatacttcagcaccaactatgccatcattttcggtctcctttctctctattctctcctcaccaactggctgctgctgtttgttatcggttttgttttccttggtctgtacggaatttcgtttcttggaggatctgacctcaaccttggcttcacgactcttacttcctcccagctttacactggtctcatgattgtcgccattccccttggattcttcgcctctcctatcagcactgtgctttggattgttggctcttctggtttcctcatccttggccatgctgccctgctcgagaagcccatcgagtcagcctttgaggagaccgtctaattaggtaacggttgtgtgggtgaaatggtggagagaacagttaaaatgtaaactaatagaacgtgggattcatcccacaagtaccctgtataacctgctgtgtaagctatagggatatgactgttgataaaaacaccatgatgaagtgccgttgtatgtatcgtactcgtagtaatgtacatattggtgttattcgttgtgtcatgtacccgtacagtccgtgaattagacatgagatagttcatgttggatatttgcgctctactgtacgagtacaagtacttcaggtgtttgtatgacgctcgcagaacagctccttgtatgaaaaatacgtattggtgagtaccttgtaaaagtaactactaattacagtaatagtgttcagtagacgggacatctgtattgtgcaaactacatcgtatcaaagtagttctacacttcaatgagcgttatgatatatctctccagtctcagcgcgtaacgaactcatcactctctggggttagtatatttcaaacgacggaacaaataactaagaatatcagctccacgcctagtcacaggcagattatcatcaaggccctttcggggcacagtagaccgtcgtgattgtggtaaatcatcatccaattgtcgcaaagttaataatactcaccaatttgttgatcacggttagtcagacgtaagaaaatttttctccacttgagagtcagacatatgcttgtcatttttctgaaatcatcattctaaccgattctaagggtgttgtaggcattgtcgtctgatgactacgaggaataaacctgggttagttgagctcatgcattgatacgatcttcaaagagaccatcatttcagaaggcatgaatggtattaaaagtttgtatcgtcaaggggaagccccattctgactcgtcatctagggaatcatcatataaggtggacggactgagcgaaacgtctgtaaatactcacgtttaggaattgggttggaacgaagaatgtattaactgaggttagtacatgtgtgataacaactcgaaagcacacccgacacacaataatttgctattgttctgtcagtgaacgagggttttctaggccctctttaagcttgtcactcattatttttcggtgcccagtgctatggttcatcatgttgcaaataataatgagagcgtgaaacatacctggagttagtaatgtggttgaagggatagacttcatttctgttcacagatcagtaaagcagcaacttgttatctaacatggaaaagagtacattcagtcggtaattccaacttaaagtagtaatcatcatatgatgggtgtgcaaatagcaggatgtacttaccgtttggtttgtagttggaacagtcggagtcagtcggctgcgttatggctacggtgctgaacacttggcagccgtgtaccgggtattaggtccatacatcgacctctttcgaggtcaacggataggccacgagcccatggtaccggtcatcgtccattgtgttgctagcgtgtaatcacacgtaggactgtgtttggataaggtatctcagtatcttctgtcctaatgttagtaattgatatgggaaatgtcgcgagagcaatcaaaaagtcagactgacatgcaaaaaacgttgtgatcataaattgcttcacatactctagtttgattggtttgttggatcatcacatgctgtccgtggtgtttgtgtactcactgttcgtagtgtgagggggttgcatcttccatgtttttcatggaagacacctacccctagagttgggtatcacgtggatatcgttgcgtatgtgtccggtgacgccattttgtcgctaggctgatgtgttccgtgttgtcgttcttgtgctcgtagcacgagtgttgggtagaaagaaaactttttctgagctatactaatttatactctcagtccggagttgcgaagggtagggttgtactgttacccggtgttgggttgtacctgaactactatggcagacccataaataaggttgtcttgacacaaccgtggctactcgcctatattacaagtctgtgaaaaggggggaagcagcgaatctgtttacttctaatcacacaaaagaccctggggtataatgattggtgcttggtaattgctgtacttgtagaggctaaactacaagtactgttgtatgatgtctcctataagtacagtatgtactatgtacaagtacatacagtaccttaagtacttgtacttggggcactggacatatggaggaggattaacatccgtaaacgaagacacaactacatgtacatacttgtacaccagttcagctcataagactgcagtacttgtagttccaagcacctacttgtacttgtacaacttgtacacgaaaaaattctgtgcaccacaaaaggaacagggcaactaactacaatacgagtacaactctgtacttccatcgtagtcagctaagcacaagtactcgcacccctacttctagctacacctgtgcagaaactactttagtgatttttaaattgacctaggtcgaaacaaagtttcgcgaataatgacattggcatgcatgccgggatcggccgatggcccgggtacagtgcaatagttgtcattggaaagaggttggaaagcacggtaaggagcccaattacatacagtcagtgacaccacataggttgcacacattattctgtacagtacctgtatgtgggaatgtccccaggctcatcgagtttactcttcttcacaaccccacagggttatcatagaatggatagcattagctaaggaggccacacccgaatgaaagcggctactcatcaaggctacaagtaggtgtattcccgattgtacaatacggctcgtttctgagatcaatattgtatagcgatcgcaaggtcagatcctcggtccagccaaattaaggttccgaggatatacttctgattttggtaccgtactgacgaaaaaggaaaggatgagtatcggtacaagtacactgtatgtactggatactcatacggattagtaacgccattgtaaggatatatctactaggttggtagtctctagagggttagttttttgcttgactgatgttacgaataagttcatcgaagacatacctgaagagcgactgatttcatgaataagttgtgccgtttctacttgtaggaactgtgtcacataattgccttatatagatacaaccctaaccactacacatactgtacgttgtaactatccttacagctattctatcatttgaatgcatgttaatgtcaaattcgagtttatcattctccttgtgatataggcatggtcttatggattcacatttcctcgaatttacaatcaattgtcactaccatggcggttcgtccaatgcttcaaaggcaaccacaaccacgaaggttaatgtaagactttctctggatgattttcatcggttgcattgaagggacaactttttattaatactggactacatgtacgatatagtagccaactacaagtacgagtagaagtcatccctgtgaagacacgaacatattttttactggataagggttcacctgttgataaatcgaaatggatttagttcataccataccaaaagaggtgtagcacactgcgaggtcaggacatccatgtgatgtggtcacacatcttactgctgcctttgatacactcgacaaataatccacccaaagcaaacggacagaacgcaatccagaaaagatggaatcgactaataagaaagaggcaaccaacaattgcgaactaatattgaccaacaaaacaatcggcgactccccctacaataacctaaactacgaaatttcctgtactgtgctttttttttttgtacacactgtgcttgtagttgtgcttgtctgtaatttactcaactgcagcatttcttcctggggtacttgaaccatgtgcgcctgtgtgcggctattggcgcgaccatagattgaaatcaggaggggaggagggaaatatctgagccacgtatcgcaatgccctataattaatcatacctgattttggcacatatgtttccatcaccgcgtaactcgaatacgaatttgtcagtgcttcagacacgtactattcgtcaggttgttctgcaaagtgtactgacagatcccgagcttagttctgcacacctatgcgaaataaacttcgggagataacaagatgatggagagaagttgccgtgtagcaatgatgaacaacacgatttcatctcatcataagttcaccttaaatcacaattgttcaaaggataacgagaacccccttctccttgactcacttggcattacagatttaatttgtcatgaacatggaaccacctctatcgtcactcttcatcatactcagtgatttgtgtcacaatcactgagtcaaacctaaaagaaatatatatacactgagtcccttctacggcgagattcagccaacctaaccacaaaaatgctacgaaccctcaaccggacaagtcgtatcttgcgactgtcggccacaaaaacccgatttggatccacattttcagcagcaacacgacctctggacacttatcttcgacgacatgttggtagcgaatctgcagatgtgaacaagatgctccgagctctagattacgctactgccgagtcagctatggacagcttcgtgtcagatgtcgttccccccaatgttctgaccaagcgacctcttgctgtcaagcccacacaaggtttctctgaatctgagctgaccagccggttgggagagattgcttccaaaaacaaggtcttcaagtcctatatcggaaagggctatgtcggaactgttgttccacccgtcatccagcgaaatgttctcgagaaccccctctggtacacctcatacacaccctaccagcccgagatcagtcagggtcgtctggagtcactcctgaactaccagaccgttattactgagctcaccggaatggcagttgccaacgcttctcttcttgacgagggtactgcggcatcggaggccgttacaatggcattcaacgctttcaagggcaagcgaggcattttccttgttgacaagaacgttcatccccagaccattgctgttgtccagtctcgaagtgtagctcttgacgtcgacgtcaaggttgtcgacgtgtctgatctctccaacggcaagtctgagagccctattgaccaggtctgcggtgttctagtgcaatacccaaccactgacggttccattgtcgattaccagaagctcagcgacaccctcaagggtgagggcaacggtagcctgctgtgcgttgccgctgaccttctggccctcacccttctcaagcctccttccgatttcggtgccgacattgttctcggtacctcccagcgatttggtgtccccatgggttacggtggacctcatgctgcttactttgctgttgccgatggccagcaccgaaagatgccaggacgacttattggcatgtcccgtgatcgacttggcggcgaggcttatcgactggccctccagactcgtgagcaacacattcgaagagagaaggcgacctctaacatctgcacagcccaggctctccttgccaacatgagcgcattctacgctatctaccatggacctgagggccttcggaagatcgccgagcgtgtcaacctgctcacctccatccttgccactgccgttgaagccaagggcgttaaggtcgagaacaagcacttctttgacactctcaccctgcaggttcaggatgccaacaaggtcatttctgcagctgaggccaaggagatcaacctttacaagcttgacgataagaccgtttctctgactctcgatgagaccgtcactcacggtgatcttgtcaaccttgcatcggtttttggcgtttctgaggctgacttggagtctgctgctgataatgtcaccagcagtattccctctgatatgctgcgaactgataagtacatgcagcacgatgtgttcaacaagtaccattcagagaccgagcttcttcgatatatgaagcatcttcagtcaaaggatctgtctctcgccgatgctatgattcctctgggtagttgcacaatgaagcttaatgccaccactcagatggcacccatcacctggcctgaatttggccagcttcatccctttgttcctctcaaccaggctcagggctacaaggagcttttgatcgagcttgaggatgatcttgcggacattaccggtttcgatcgaatgtctctgcagcccaactctggtgctcagggtgagtacaccggcctacgagtcatccgtgcctaccttgagtctcagggccagggccaccgaaacatctgtctgatccctgtctctgctcacggtaccaacccagcttctgctgtgatgtcaggcatgaaggttgtcgctgtcaagtgtaagaaggatggtgagcttgatctcgtcgatcttgctgccaaggctgagaagcataaggataacctggctgcgttcatggtcacttatccttccactttcggtgttttcgagcctggtgtcaaggaggcgattgatattgttcacaagaatggcggacaggtatacatggacggtgccaacatgaacgctcagatcggtctgacctcccctggtgagatgggtgctgatgtgtgccatctcaacctccacaagaccttctgcatcccccacggcggtggtggacctggcatgggccctattggtgtcaagtctcacctggctcctttcttgcctgctcaccccgttgttgagatgagcgaggttacaggcctttctacagagaagtcaattcagcctgtttctgctgcaccctttggatctgcttctatcctccccatctcctgggcttacattaagctgatgggtgctaccggactgctcaaggccactgaaatcgctctccttaacgccaactacatgaagaagcgacttgagccccattaccctattctctacaccaacaacaaagacaagtgcgctcatgagttcatccttgacatgcgacctttcaaggcatcgtctggaatcgaggctattgatattgctaagcgtctccaggattactctttccacggtcccaccatgtcctggcctgttgccaacactcttatggtcgagcccactgagtctgagtctctagcagagcttgaccgattctgtgatgctctgatttccatccgacaggagatcaaggagattgaggacggcaagattccccgggagaacaacgtcctcaagaactccccccatcctcaacaggaccttttggccgagacttgggatcgaccctacaccagagagcaggctgcttatcccgtagctagccttcgagagaagaagttctggccgtcagttgctagagtagatgatacctttggtgatctcaacttgttctgcacctgtgaacctcccgctctcgaggagtagagtagtaacagttagtattgttacagtttcaacagtcaaatatttatatgttcaacacgattataactgaatgtcgtcattgtttttagaggatcgatcgcgttatgtgtttgtatgtgtagcgcaaatacaatgattagccaccgcaagtatgtacagtacatacatgcagaacaaggatggtgttccttggatcaacactacctcattttttgatagtaattatcaattaagtatttctgtttattataaatatcagaaggatgtggtttatgttatgaactccaaagggcatatacgaccccagtaataacgattggtacacgctctcctgaacacccaaatcgagtccgatgtgctggtttaacgttgcctaccgcgcttggaattttcctcctattcctcctctaaaccggagaataataataaatataaaaaaaaattatggcaaaaaatcatggcaaaaaatctagtacagtagtcgtctcaagatgggccgttaagggccgctgattaacgaagaagctgtaatcggtgtgatgtggagtacatagtgtagtataatgtgtagtcggtgtaacgtctggtctttgtgacgagtattcgccccgtctgtatgattgagtggtctgtgtgacggttgatcttgtcgacaagggccggtgtaacttgttaggctgtatggggtgtgtggtctgtgcggctgttggtcagatagacgtcgtatggtattcggcctcatacacaatatgtgaatttatttcataagtcgaaaaaaaatcattgtagattcctaatggacaagatttgcatcaagtttgtctgtggtctgcgttgatactatggtaactagcaatatgcctttccatggccatcataaataaaactgaaagcattacatttctgcacctcttactgccagagcatcagcagcatcatttccagggtcacttgaatggcctttgaccttcgtaagccgaactctgtcgcccagagatatcaagagattcctagctggcttgataatatcttgattgctgacatcagcgcctttgctatttttccaaccatttctctcccagttcataccccactccttcaagcaagagatagaatattgggaatcagtccgaatgtcgtagtagcgtcggtcgttacgatccttgatgatcttacacgcttcataaattgcagtcaactctgcccgctgattggtttgctgcatccctgccaatggcttgctgacattatcttcgctgccgttaccgaagaaaattccgtatccagcttttgcgttcgaggactgattgttgcgcgatgctccatcagtgtaaacaggtatggggtggtcggcacctcccagaacaatcgctgttattccacccacatacgctgtttgtactggcacagaagtgtctgacagcctctgggcgctggctgctatcgtgccaggcttcgtgacctttgacgatgatgttgaacttcttatcccatatccgttttgtctgagaaatgcttccgctgcaggtctattggtgaatttctgatacgcgcttccagagaacccatcaaccaaagggctcacttcactccagcttgtgtagataccaggtttccgtcctttctggacagcataaaacgcctgctttggtccgttttttttggtcattttcaatactgtgagtagtctgtattgctgcaataatatccaaggactttgtcgcatatatagccacaggcaaagaggatgctgctggtggtaaggtcaggtcgcaataggtcgccacggtcaccacggtcgccacggtcgcaataggtcgcaataggtcgcaatagcaggaaactgagttcagaccttcccaagatcgagtgcaagaacactgcaggtgtgttaaaaacagtacagtacatactgtagtgcacgcacacgttgaaacaatacagagaatatttagaggacaattttgtgtcaatcagtgataactcagtgtaataatttgaacttgcagggaagatgtgatgtgttgttttctgtcgtgggtatcagaagaattgatagtagggggcgagagttgaagaaaaaatgggtttctaggtacgatttttatctggaaaatggcttgctattaattagtatgagtgccaattgaacgaagtgtacagttgtaatttacgacaggcaggtgctctcgtcgccactcttatgggatcttcaataataccaatctctctccaatctctctccattataactccattataactctctagccaggcgcttaacataagatcatactgacccaaatcaactcatgtaagcgccgtactcggtgaaagtcatgttaactacagcatgtactgtatgcacatacgaatgtactatgcttctaatagttacaacttcaacaagatgatgatcatcttaaaaaatcagctaccgtaggagcattttttggtcatcatcaaaagtcaatgtctacaatttttgatactactaatatattatggttaaaacatgtttcatcaaaacaatgcttactctgagtactgggtgaacttgtcgacgatatcagcatcaagcttatcaaactccttgttgagagcttcctctccctgcgaaggctcaaagaacttggccgaggaaaccttgtgcttaatgtctgcagttttctcagacagcttggaccaagaagcaccgttggaaacagctcgctgagcctcatcgtgataggtgatgaaggtcttcatcatggcagcagtcttccaaatgggacagaaggcatcgtaagtggagtatccgttttgctgaaggaagtcttccttgagaagagtggccacatccaaggtaaccttgtcagtatcagaaagagaagacttaccgacaagctggacaacggtctcaagctcctcagcgttagtcagaatctccttgatcttatctcggttctgaggaaagacctcgaaatgttcgttgtagtacttgtcaagcacagtggtgtacttggagtaggatacagcggtgttcacggaggggaaatgctttcgctgagccaacttcttgtcaagaccccagaaaacctgtgtaataccaagagtagcagtggtaacaggatcggagaaatcaccacccggaggagacacagctgcgacgatagaaacagaaccttctcggtcaggtccaccaagggtagctgctttaccggctcgctcatagaaggaggccagctttgcaccgaggtatgcagggaaaccctggtcggcaggcatctctcccagtcggccggaaatttctcgcagagcctcagcccatcgagaagaggagtcggcgatcatggagacgtccttaccctggtctcggaagtactctgcgatagtgataccagtgtaaatggatgcctctcgcgcggcgacaggcatgttggaagtgttggcaaccagagtggttcgcttcatgataggctcctcacggccgtcgatctcaacattgagctcagggaactccaggagcacctccgccatctcattacctcgctcaccacatccgacatagataatgatgtcagagttcgagtacttggaaagggactgagaaatgacagtctttccacaaccaaaagcaccagggatacaggtagtaccaccctggacaacagggaacagagcgtccagaactctctggccggtgagcagagggtagttggcagtaagtcgctcattcacgggtctgggaactcgtacaggccacttctgcagcattctgtacttggtcttcttaccctcaaactcaacctccagaatgtcgtcaacaacagtgtagtcacccttgctggcaatccaggtgatagttcctcgagctcgaggaggcagcatgatcttgtggtcagaaagaagggagttctcaaaaacagatccgtagatgtcaccaccggaaatgtggtctccgaccttgagagggccaggggtgaaggcgtacttcttctctcggtttagagcaggggcatcaattcctcggggaatgtatatactgtcagacttctcttggatggccttaaggggtcgctggataccatcgtaaatagtttccatgagaccggggccaagctcaacggacaggggttcaccagttcgggtgacagggtctccaactgtgacgccggctgtttcctcgtaaacctgaatagtggctttatcaccctcgattcgaatgacctcaccgaccaggttgtcatggccaaccttgaccaattcgtacatagcacatccgatcatgttctcggcaatcacgacgggtccagagacggagtaaatggcaccttgggccttgtcatcgtcgtcgatggagagagacttaagattcttagttgtcttttcgggctgagttagtatgttccaattgtctgagtgggtcgtaggtcgacgaagatgatgttgtctaacatggcggcgttgtagtacctaatgcattgccggtggccatctcccaagcgatgactctctgtttttccaaaacctcgatggcatgctccaccattgtcctattcaaattagaggctcaactagagaagtctccttgtgactgttcaaaaaatgacatcacaagtaaatggctgtgtgtcaaattgacggtgtcgataagtatcctcgagtacgtccgatgagccattcgcaccattgaggcaccattgtctccgagctttccccatcgtttgtgtgttgtcgtgatcgttcgtaagttgtcgtcgttgacgactgtcgacgtcatggggggcatctcaaaaatggaacgttttaaccaggtaaagatacacgttgtacacatgttcgccctcgcaacaatccttgtctccacccctggaatcggctgcttatcacactcaccattgtgttgttgatgacgttgtcgagagacagtacttgtagtagtgctgttgtcctgcgttgctgggagttggccgtcgtccatgcgttgtcgtccaaacgctaatcaccacacaaactcccacctatcaggtttgggttgtacacagagaagggatacagccacggagtgtagttttgtaaaacaagaataaaaaagagtccccaaaagtatccttgctcttctcatcatggggtctcttctcctattgttattactatagagttccttgtcacagtagcagtgctctgactaatcgactacagaatagagtagatgaggcatgagatggaaataagcttctgtcagtgatgtatcaaagaccagtgcaatactacatactgttacgtacatatgatactaagatgcttgtagtgtatggtgatatcacagatggcgattgtaccttacacgaattcagcacattattaactctggccggtatgaatgccagtatgcttactgtgaacgatacgttctagggtattactcgtacggcacgggtttttcattcaccatgtatgatcttcctcacctcatcaccttcactgtaattaatatgtgcagaataattggggcgctttggccgtgtcactcgattcgcttattaactcagtgtcggaaccctaaccttttacactacgtcgccttccatatgatatctccctggtctccgcatcagtggactgtggtgtagggtaggcagaccgggttcaagggcgtaatcaccgggaacagcacgttatcgggatgggacctgtgaagagaacatcatgcctctaggtctcggtatcagtaaactgcgtgcggggtgcaggacctcgaagaaaatcaaggcagaccaggttcaggagcgtaatcgctgggaataacacatagtcggatattagtacagtgggaggcgtgcctctcggtctcggcatcagtaggctacaacgctgggggttcgtggaagcctcggaaacgaagcagaactggccataggtgcgggcgccggggaacggcgtcacagtcgggatcggatctgtgaggggggcgcgttgatgtcgatggcgtcaatgcgtgtgaagtaggcagggttgcaattttccaggatacgaggtaggagttttggctgggccgcttccacttgaggtggatgaaagctgtgcggtcggcgttgagccagttacggatgttacagcgtctaaacgggaggttcgttagtccattcgggtagtgcgtgggcgaggcggacgttgccgatgttggccactctgtagcggtcgtgaagtagggtggggtttcgatgacgatgccactgtcgtgggcaaggtagacaactggctgtggtcccatgtaggagcctgcggctcgggggatgtggcctgccaccatcttcttgagtttcacgtagacgtaacagcctggggtgatggttccggcggttcgacagcggcaaagcatcgtctacatgagttgatcttgggcctgtataagacgttccagtactgaggaataagtcagatcgcggctctcctcttcttcaagcaggggacagtggcagatatcgttgctagcggaagagcctcgtcgaatggcatgtagtggggagtttgtagggtggcttacaagtggagcgttctgtggaagtgttaatagcgatatcagtctccggtaagtagtcggtccacagtttcacctcttatccagtgattcggcactctgtaattttggcgaagacatctttgtcattaatatacgtacagtatatacagtacatactgtacctgatgcgttagttcgactgtgttgaagaagagatgacgttaatgtagtctctcgattcgctaatgtacagtgtacccgtacatactatgccagcagtatcgtgtaagtgtaaagtagcaatatttacggttctagtacaagtgtgtatgcacgtacaagtcgttgtacagtaagaacatcacgcgaagccatgatcccaaaatccggggggataaagtgacttgctggttcgtcatacaacacaggtacactgtatgtacggtacaattacgacaacttagggaaggaagcacaagtacgagtacagtacatgtactggtacttgtatgaggcaatgggacttctacccttatcccgcagttgagcgtggtccaaatgatgcaattgcaactacaagtaggacacttggaatgtcagactggtgcttctcgcatttaggctaccatcctttttgcactttcatcatcctttgctcccttatcaattctcgatctatccaccatctgttcggttgcctattttttttgcttattaatgttacgttaagcttcttcatcacatgatcattcccaatatagaaaaagactgtcacaattttcttgtatccaaaacaggctaaccctaaacatatatttcctcttacggcgttggggactgcaaaagtatactcccattttcacttttcaggtccctcttttctagctgtacgaacgacacgaccaacagataaaaatggtgggtattgcgcaagggaacgacaagcgatggatggatgtgatcaggacagatatgactatgccggatattcaccgtgaagaaattgcagtatttctgaaccaaagcagtccactattgatttggttgcggtgggtactattggaagaatttttacgaaagatccctggaggttggactcgccttggtgtctcctcacgactactttcgggttctctcaacgttggcatcccattttcaacaaacggcaaaagttctaggtaacaagttcagtgtgaggagtctcggtctgggcggactaaatatctgctgggcgtgcttctttacctggaagatccagtcaacaaccatcatattgaggaccgggaaaccaagcgagcaattactaacatagaccaaagtgaaggcttccgaactctctcgattctccaaggctgagcttgagggcaagcttgtcgagttcaagactgagctcgctaacctccgtgtccagaagctcggtggtgcccagagcggtaagctcaccaagatctacgatgtccgaaagaacattgcccgagttctgaccgttctcaacctcacccagcgagagcaggtccgtgagttctacaaggacaagaagttcctgcccaaggatctccgaggtaagcagacccgagctatccgacgacgactcacccctgcccaggccgctgccaagactaccaaggctaccaagaagcagacccacttcccccagcgacgatacgccctcaaggcttaagtcaaagggaactttctcttgtattaaaataaaaggcatttatggaccacagtgatatatatatatgtgtgtgtgtatacatacatgtatgctgtagtacatccagaagtacaagtacaagtagagccaatcagagagctctccaacatatctctcaagtacatacagtacagtacagtacatacagtacgagtagttgtactcatacgtcgtacttgtaatgtcagtgtttggtttttaacactggtacgagttttagctggtacaagttttagcttctacttccattctttatcaggcatgaatacttgtgcttgagcggtatgtgcttgacagatactgtacagtaagtactgtactgtacttgtacatgtctatacggtgtcgtcctatagcacgagtattaagctgtagtgcagtactgtacttgtagccaggttctcgagtagacctgttgcttgtggtatggtggagaggtgccgccacagagctgggtgaatctcaatatacaaggatgtattgtacaaataccacaaaagagtatatgtactgtatgtgctagctaccttacagacttgtgtctggtatgagtacaagtgtaactgttgctgctctcagtagtagtcgtctgctactgtttctgatgttggtacggtagagtacgggtaaccataatcgtaccaatgtgtgcacataatagtattactcgtactgtacacttatgtgattataaagaaaaacattcggctcatatggccattatccacgcaactaaccacagtacaagtacgagtataagttgtatataggaattagttgcacacgtgagtgatcttagtggtatgagtattgagtatgtatgcagtgtgcaaaatgtactgcatactcgaactgtatccacagcagtgctttatctactgtagctacaatactgtagttggtagtgccgcagccggaagtggcaaagtggcaaaacacgaactatcatactggcaggtagcgcaagccgtagaccgattttaaggcgatcccttccgtagcagctgtcgatatattgaattttccagcccttctgtacatacattctgtagcacatttaccacagctacaggtacagtacccgcgcaaggatatcagacacagtgagccggcaatgggaaaggatgtgctagtcacttgaacttggtgcacgcaccgtcagccacagtaaggcacacatactagaatcgcttcatctacaagttacagggcgtctcgctataagcactctctatgcacgtcaacattttgttaccctacagtttctttgccaccaaaagcgtaggtctggaaactacacccactcaattttgggatccgaattttcagaacctaatttatctgttacccggcctgtggctcgcacagcttaaaaatggtcaaactttccccttcttgtctttttttcctcacattcatcaggttcttgtcttgatctttcaagtgagtattaattaccgaccttggttcttcattgggagagcattggaagccgtggtgcagcaaccacaaaacggttcttccccttcgataccttcttgcctgcctttcaatacaagtcggctcgattagcggtggtcgcccccgccagcggagaacatggaactaacccagaatgagagctaagtggagaaagaagagagtcagacgactcaagcgaaagcgccgcaaggtccgagctcgatccaaataagcggtttttaacggagatttaacactaaatcgaagaacttttcccgtttcatttgcgaatgagctcgttaacaaaatcccccagtttttttatccagctgtaaggattgacattagtaatgaattattgtttggtatatttaaatctgtagttcctttctgtccgtgtcggcaactgtcgtactcgtgatttacttgtattgacgaatacttactgtagcgcactctgctgctactggtcgtaaggatgtgctatttcggtgtatggtgggttttttgggggtcggaaccgaagactgttacacgggcacggctcgttgtgtacacgcacagagctcttgcgagtcatgttgtagctagctcgtcgtgttcaggaactgttcgatggttcggagagagtcgccgcccagaacatacgcgcaccgatgtcagcagacagccttattacaagtatattcaagcaagtatatccgtagggtgcgggtgatttggatctaaggttcgtactcaacactcacgagcagcttgcctatgttacatccttttatcagacataacataattggagtttacttacacacggggtgtacctgtatgagcaccacctacaattgtagcactggtacttgtacaaagaatttattcgtacgaatcacagggacggccgccctcaccgaaccagcgaatacctcagcggtcccctgcagtgactcaacaaagcgatatgaacatcttgcgatggtatcctgctgatagtttttactgtacaaacacctgtgtagctccttctagcatttttaagttattcacacctcaaggggagggataaattaaataaattccaaaagcgaagatcgagaaactaaattaaaattccaaaaacgaagttggaacacaaccccccgaaaaaaaacaacaaacaaaaaacccaacaaaataaacaaaaacaaaataaatatataactaccagtatctgactaaaagttcaaatactcgtacttacaacaaatagaaatgagccggccaaaattctgcagaaaaaaatttcaaacaagtactggtataattaaattaaaaaacacatcaaagtatcataacgttagttattttattttatttaataaaagaaaacaacaagatgggctcaaaactttcaacttatacgatacataccaaataacaatttagtatttatctaagtgcttttcgtagataatggaatacaaatggatatccagagtatacacatggatagtatacactgacacgacaattctgtatctctttatgttaactactgtgaggcattaaatagagcttgatatataaaatgttacatttcacagtctgaacttttgcagattacctaatttggtaagatattaattatgaactgaaagttgatggcatccctaaatttgatgaaagatgaaattgtaaatgaggtggtaaaagagctacagtcgttttgttttgagataccatcatctctaacgaaatatctattaaaaatctcagtgtgatcatgagtcattgccatcctggaaaatgtcatcatggctgatatttctaactgtttacttgagataaatatatatttacaagaacttcccttgaaattaatttagatataaaatgtttgcgggcaagttactacgaggaataaattatatctgttgactagaagttatgaacattcagtatatatgcacatataataaccaacttcgaattttccaaattaggaagtaaattgttataatgaaacatagttttaggtttttatatattataatggaatacgtctccattattttcgccatctaatttatttaatgaaaaagtttagatagatgatctaattttatatattaaaatagatggtgagagaaaaaaaatggcttgcatatatatatatatatacagatcttaaaagatgtcctaacacgtagtctttaatctttattggggacaacaacataacactggaagattaattcgacctcattcatgtatattgatctaataatattaatatcgtttgacgtttgttctccaccctacatcatgataaatcatccccattaagactttgttgatagtaacttatttgtaacttatttgtttattgtaatttattatgtctctaacttatgaaatcgacgtcaagaatagttttgtgaaaatttttgcgaaatttgttctgacccgattacccgtacaagtccaacttgatataagtattaattaaagcaagttaggtttactcatatttccaggtttttaatttttgttaatgtacgttgtaacgtaatatctttttctgctttcgggttaacacttttttacagttgcttaaaaactgttgtctacttgtagtcgattgaacttgtattcttattacacttgtgctcccgatttcgttctcatacggcctttaatatgtaaatgtcttaagatgctttttgtctggagctacaagtatatattgtatatatatatatttgttacaggacagacttcgtgcaccgcacactattgaagattataagtattattgatgtgatatagttaattaacaacttacaacccacttctaaaaaaaaaaaaaaaaagggacacgacgttccgatagtagcacacacccttctggtgtgtgcttgctcattcaccagaaaagagattctagatcagtggataaaactatctacaggatggacatctcttctacgacccagctgattcctcttattactatgtggtgacatctcatcattatgtgaggaattagccaggtattaccccaccgggtattaccttcaacacaccaagtattgtacgatttgttttgttcgcttattggttttccttctcaagtcaagcagatttttgaattcacttcccaatcatggaatacacatacagagcaacagtaattttggttttatcttcacaacgtcatatcggttggaatctacaagttaatgtacagtactgtagtacaaatagaatggtttgttacaccctgtacttttggtatttattttcttttcccagaagcagattgtggtacgagcacagaatcatgttgtggttgtgtcaacctgactacaatacagtacagtatgtacgtacttctacggtgaagttaaaaaagctacattccatctcacctgcatcacaattttggttcaaccttgagcaaccatgagacgattttcgaccttgtcgcgtcgccttcaaagggttgtaccggcatcttcagcctcgaccgccaatacaagtccttctcctgcactctacactggtctagagcccaagatcaaggagtcacaagattcgctaattcgggcggtttttgataacggcgatgtgtggcaggatttctcgcaaaagtctgtggcaaagcccaagcaatctcgtagcattacgggatttatcaactacctgaccaacgaatctgattacgaaacggggctatttatgaacgatttcctcaagacccccgcgggatttcagaagtacactgcagcctcaatcgaagaggcgggccagttgattcagcagcttctaggagcgcttacccagcgagacaagctgcgacacgccattaccacatttgacagactatccgacgttttgtgtcaagttatcgatctggctgagttcattcgcgcagctcatccggaacagcattttgtgcaagctgctcaggaggcacacgaacaaatgtacgagtacatgaacgtcctcaacacttctgtggagctgtacactgtactcgacatggtcttcaaagattccgagattgtcaatcagctcacccatgaggaaaaggtagtaggaactctcctactggaggatttcaagaaaagtggagtaaccctggacgacgctggacgggaaaacttcgtttcattaactactaagatctcattacttggtcgggacttcatctcctccaaccatcctaaggaggattacatcactctcacccagggtgaggcccaggggctggacccacaacttgcacagcagttatcccaggggaactccgtttacgttcctactggtggtgttcccgggcaactggctctgagaggcatgaaaaacgaaaattcgcgaaaattgctttggtctaaaatgagggagtcgtcagacaaatctattgaatcgttggaagacttacttgttagccgcctggaactggccaatctaatgggaaaggaatcgtacgctgattatctgctttcagacaaaatggctggtaatcctgaaaatgtgatgagatttcttaacggcctcctagataagacacttcctggcgccaaaaaagagctctctgtgcttgagcaaatcaaaaagcaggcgactgggaaccccaaaagcatcctgcaggcatgggacaagtcttattacgcctcccagctactctaccaaaagagaaacaagacgaagacagcccacatgctaagtgaatacttttccgtgggaactgtggttcaaggccttagtcggatctttgacaagatttatggtatcaggtttgtaccgactgagaccaaaacaggcgaaacatggcatcacgatgtccgacgactcgacgtggtatctgaaacagagggtctgatcggcatcatgtacgctgatttgttccagcgggagggtaaatctcccaatcctgcacactttactgttcgttgttcgcgcgagatctacccggacgagttggcccacatgagcagtagtcctattgccaaggttccaacactgaatctcaatggcaaggtgttccaaattccaaccatcgctctcatttgtgatttcactactccccatgacctctacccttcgttgctgtcgtatcaggaggttgagacactattccacgaaatgggacatgccattcattctatgctggggcgcacatcgctccacaatgtgtgtggaactcggtgtgccaccgactttgttgagcttccttctgtcttcatggagaacttcgcatctaaccctgagtcacttgcgctctttgcacgacactattcttcagatagccctcttccttaccaacagctggagcgccatttgaacgaacagtcgtattttaaggacgttgagcagtatacccaaattaagatggctatgttggatcaggtgttgcatggaaatattttaaagagtatcacaaatggacacttcaactcacaaaagctatacgacaatcttgagaaggatagaccgctatttcctccttccccatcctcttggcacggatcgttcggtcatctttttggttacggtgcgtcctactactgttatctgcttgaccgtcaaatggctgacatcgtctggaagaagctgttctcaaagaacccgctatctcgtgacgcgggatccagaatgaaaaacgaagttctgcagtggggaggatctcgagatccttgggagtgtattgctggtgttcttgaagatcccgaactagcaaagggtggctcgcaagcgatggagaagattggaaattacgacaaacattgatgtatatgtatataggaaatctcattcgcatttgagatgctacagggcttgtccctatgaccatgcttttatcactaaaatactttggaccccatacaatggtgcaacaaatgatccatctacttgtacttacaatatcgcaagtatccccaatatatgctcatttcccaaatggaattgtcagctgcttcatttaacaaaatcaatctgtacttgtagcagcaaggtgcggtgcggtgcatttggccggtacagatggtgccaacaggctatctcaggcgttatcataggcgcgtaaagttattaccgcctgtagtgggcacttgaagccagtttcttcggtcgtattcacactcgccatcaatggcatggaaagtatatgcaaatcgacttttttgactgacgtttgcctcagacttgtgcaggacggagttgtgaataagaaccagagaaccagcgggaatgtctaagactttaaattcttcttccgagggctctggaccagcacaaatatcttcaacatcttcgaaggtggtaccaccagcaccatctctcacaaatcgcttagagacaggatgcgtcttgtgcgaccccggaacaaatgcgagggtaccattatgtgaggtgcaatcttccagagcataccaaaaaccaatagcgctttgaggcttcgtgtaaaggaacgtgccgtcttggtgactgggcaccttgcctccaatttcaggttgcttgaagatcagcatagattgaagaatttttggatccttaagcccaagggaggtcgcaatatctctgttccttgctgtaacactcattttgttgaattcggggttcagatcgtgcaaggcatgacctattttgttgaccgccttctccttggccacagtcagtttgccatccctcacagcgccctcttcgaagaaaaatctgatcttatcggagctctccagaaagtaagcatctccaatatgctttgcgtcccctgaccctagactgtctcccgttgagaacttggtcatggggtgtccttctagagagaattctgatagtaaccggtggctctcctggagcagtgatgagatagtttctggagacagctcgttggggacaacgatacatccatctttttgaaatttctcgatttgatttggtgtaagcatgatgcttgtgcgtgtgctggaagaggtgaagtctctcaataccttgcaggcggagcacagaaaatataatacagtattaaggtttgtggggtgatccagttgaggtggagataaggtggatagtacgacgtacagacgagtatggtatgtacatgtacagcacatacagtacatactgcttgtagtgcaagtaaatttctacgagttcactgtccaatttttgtagaaccagagatttaccttgaggggccattgaatgaagttcgcacggacccatatattctgaacagattccgaaatgcttatcagagtttgagtgacctatatacgtacagtatgtactcgtaattcatactaattattactatttagagaagcagagaatagaaacaggaagatctacttgtagttgtacatataaacaacatagcatttaaaatcaaggtgcacaagcgtgctcatcgaagacattttttttattctaatgattcattacagctatatacctagtaagccgggtggttttttttttggcgttcaataaatcatacacttataaatcgtttcggtgtgcgctgcaaggcgcgtgtcagttggtttgtcgacgcttcgtcttgttcttgtccttgtcgtggtctcgtggtagtgaatcaaggctatattgtctcgtacaagaacaagacagctatcagtaatttccatggtttttttagcatcgatatagtgacaagccagtaaagcttcctttgatgtagtaacgcatatatattcaagtgtaataattaccattcttatcatgcttggttctattatgtgcagacgtagatgcttcacttaccttccttctagtcgtacgtagtcagcgaccaagtacaaactgccgcacacaacaataggagtgtctcgcccagcagccttttccaacgcaacttgaatccccccggcatcgagaatatccacattttcaagtccttgcaaacctttcagaatgttttcatgggtctcggacttgacccatggcataccttccaccgcagaaaaccccgtggtgataactgtgtcgcctgatctaacaaattcctgtacgatctcacttacattcttgccttctgagaagcccaagatgaaagtaatgtggttattcgatggctcattgcgcatgctaacatcgatgtactcccctagcaacctagctgcctgggggttgtgggcaccgtccaacaacacctccctgcttttgtagtgacacatttgtagtctgccgggccattctgttgcactaataccagcaacaacagaatcgcgctgaacctgtgggtaggactgtgccacaatctcaagtgcatcgacagccgctgcaagattctcagcctgatacgtgccctttaaaggacttagggagggctcaagaggtccaaaatcagacctgtatgagtccgtcccactttcagttacctcagtcacatactcggctacatctctgactcccattttagcgtcagggtcgttgtatccgtcgagaatcagaggaactccaatttttgcgatgcccgccttttccttggcgattgccctgagattgtctcccagaaagccctcatggtccatacctacacgagaaatcaccgacaccagaacattttcaggacagaggacattggtggcatccagcctacctcccaggccaacctccaccacggcgatttccacactgtgctccatgaaaagttcaaatgccgttgcagtaagcatttcgaattctgttggctccagttttccgtttttagccacctcacagatcttggcctttgccgacaagaagtcgcttttttcaactgccttgccgtctattgtgatgcagtcccacacataagcgaggtgaggagatgtaaaacgacccgtcttgatatgtgaaacagtcagaaccgacgaaatataagcacaaatcgagccctttccgttggtaccggcaacatgaactgccttaaatctgttttgagggtttccaagcagtttgagcaaccgcgagattcgagagaggcccaagtcaatcatgccagtgtcgtatggtgccgggtttttttcgatcggaacgagagaagaacgattggtaaaagtgctgctgaataagtaattcaaatagagggcaaaagcggccaattgacaagtatcgtccaagtggcacgactggtacaaggtagtgaatgcatgtatcgtagctatgttgggaagaccaacttaggtttagcttctgcatgttagacttactttcaggctactgtaatttgggttggcgggattccaatgcgacctcagaatcacgtgacaagatcaatgaacaagaaaatagctaataacatgcaatactagtgtgtatttgtttccacacacacccgctgtatattatgtaaagagatcaccgctgtcttgttacatgtcgatgtcaggacgcttcggttctccccttcacgtagagccataacaccaccacgtggtgtgaaagatgcactacatcagtatgtacaggtatgtacagtatgtacagtagctgcttgtaccgttacttgtaccagcatcgtgcatacttgatgggtttgaaatcgacgaaaaacttgcttttagtatcaattttagaactctcaatctgcccaccttacgaacacatcccctcctccactttcccaacacttttgaactggctcttcttggcgcccttgcccaccgcttgtggattgggttgggaatttagcctctcgtttcatgcctcacattcatggcaagtatgatactgtactcgtactttactcgtactgggggttgccgtgtggcactttcatacaaagcgggtcaaatagagtacactttgcatttactggttaggctaagagtttttcctgattcctcccgatttttccaggcttccgtggttacaacaacagggttagggtgcggttacgcggttcaagatcatacacgtgatatacacagtgtacaatatattgaagatcataagtattatggattagatatagttaatgtaacgacttacaacccacttctagggacaccacgttccgacagtagcacacaccagaagggtgcgtgcttgctcattcaccagaaagagattctagatcagtggataaaactatctacaggatggacatctcgtctacgaccaagctggttcctctcatcactatgtgacttctcatcattatgtgaggaattagccaggtactaccctaccgggtattaccttcaacacaatacacacacagaaacaaacttatattgtagcgacgtatcatgatacaatactgtacacagaaagcgctgtccataatggcatcctacaacgtcattgattactaaacattgcacactgtattataacctggtgtaagctacaagtaatagtctttgcacgggttctcgcagttagagcagctaccacagggagagtccttcctgatgattctaatctctcagaggaaacatcttagagtcgaaaatctctcggggtgaccatctgaatccagacacgtaggcgatataagccatcagtccagacatcgagaagataactgctaaacagacaattagcgacagggccatctcttttcgttcaccttccagttgtgcaatggttttagcggggggtcctcgctgtctcttgatcagagccgcatgctgctcgatcttaccgcagagcacagacactcggaagtagttggggtcattggggtcggacttcttgtacaccttccgggcgtatcgagtgaaaatgtcacatactccagaaacgttgctggcctcaagaatcaggctgacagtagttcccttgcgcaacttgacgttcttctggaaaacgtcggggtttcggtagaccaagtccagggtagcaatggccatgacctggggaatggcgcagaaagtgaaggttgaaggatcggtgacgttgtcgaggtaatcgaggcagtctgtggcatgtccgagggcatttgcaaccagatcggaggtgcaatgcaaggccttcttggaatacttcgggtccttgaaatctcgcatttcttcggcgtacttgtgccagatttctcgaggccagaaagctctgttcacgtcaatgtcttctctgtagtctcggatgatgttgaccttttgcaagaacaagcccatagactcctgaagtcgggggttttcgtgcaacacgtcggttccaaaaccagcgagaatcgtaattcgggtaaggccctcacccacgatgccggcaacatgatgacagtacagatcataagcggcaatggtgtccacgccgttgttgttgaagtcgtcatcaatgacgtaatcggccattccgtttcccattctgtcggtaatgtcgtagattacttcctggtacttgggcttgagcttgttgaactcagtcataaccacaggaaactcctgtagcaccacacgatctcgctcgttgggatcagagtcggtgaacttccagccaggtgtcttcatgcacttcgtgaagtctcgaagaattgggatcttgatgtcacgcgacagagtcatatcgtcttcaatcgtgtcgagagcacgaagaatcagatagaacagcattacagcgtctcgcacctcaggatgcagttctcgaataacggctgcaaatgatcgtgagcacacgtctagaagctcatagcatcgtcgcagctcagtggactccttggaaagatcgcggggatgcagaggctgacgccacagcttgtagtggatagcagcagacagttcgctagggtgcaagagcagttcgatgagttttcccatggtggctgaaagtggtggttcgaagttggtgaacaagcgagtttgtgtccctgaactctaaacgccaaataaaaacttcagaacaattcgaggagggtcgtgaaatatcgacgtggggataattgaatatggagtacgatatatggatcaggtgtgataaaactacttatgctcatttgatcgactcgatttttactttgccacgctgatgccgagttgaagcgcttccattctactacatcgctaattagcttcggagacatcaatagttgtaggtacaactgtacttgaactgtacgagcactcgtaaggtatcaatcaactcaacacaatggatcattagaaaaaacaaaaaagcaacaaccacaaagccttgaatttggttcagggggcgtttaagagcgcatgaagcctcttccaataattaatacttcctatgaaaagacgtttgactcgactctaggcaccttgtagtcgtacagtaataccgtcccaactgtacttgttagttctagacctgcaaccttatattagcaacacgatctacccgagcagaacgactatatacggttgttcatatacgaattacaagtatcgttcagtacatgtactttttaccgtaagtcgtatttcactctgaattagaaatacttggctgggagttcttgaccacgagccctttctcatgttttggaatgatcctgatagacactaacaaactcatggattggtaacgttgcttagtaaatgaggcgaggaatgccgcaggatacataattgtaatagataattgtaattgaaagaaaatcatatacaagtacataaccccgaagtaaaacagataggctttgccattctcagccgctgagaggatcaggtcaaccccgcaacactgttcgagtaacagatagtattactcgggcgagtacgatagctcccccaactctcaaccttaatcagtgggcaatctaaagtacatccagtacactacagtacatacacccccacacgagacacacaactcttaggaaactgatatcaatggccggaagttctcgaaaaaagctgctgcttatgggccggtctggctctggcaaatcctcgatgcgatcaatcattttcagcaactactcagcttttgacacacgccgtctgggcgccacgatcgatgtggagcattcacatttgcgatttctaggccacatgaccctgaacttgtgggattgtggtggtcaggacgttttcatcgacaactatttttcaacacaaaaagatcacatatttcgcatggtggaggttctgatccatgtattcgacgtgggttccaaaaagctcgccaaggacatcgacatctttcagaaatgcatcaagaacctgcgagagttcagccccgacgccaaggtatttgtgcttctacacaagatggaccttatgcagctcaataagcgagacgagatcttcaataccatgatgaaaaccctggaggaacacgcggtgccgtttgggttcaccattagaggcttccagacttccatctgggatgaatcgctgtacaaggcctggtccagcattgtatgttcgctgattcccaacatgaccgctatccagaaccatctcaagtctttcgccgaaatttccgaagcccaagaagctgtcttgtttgagaaaaccacgttcttggtaatctctcacgcatctgctaccgcagaaggcgatgagaaccttgaccctaaacgattcgaaaagatctccaacatcatcaaaacgtataaacagagctgctctaaaatgaaatctcaactcaaaaggctcacattgcatggccacaattgctcagcctatatcgacaacctaaccggaaacacattcatcatggttgtgatgcctcctagggaagcccacgaaggcactttctgcgacgatgacggatccgtaattgtgactaatattagggcggccagagaatggtttgaaaaggtggaattattggagggctaacaataaggtgtgatatgataggaatatttaacttgtataagtataaatacaagtgcaatacttgtaacttcaagttttcaaagataattgtactgtaccagtaccttgtacaagtacaagtagccggggtcctgcacaaatgacgattacttgtacttgtaatccagcgaagtaatattaaggtttgacaagcgatctctgaaaggtcagcagcacccagccctacaagtacaagtgttgtacagtactgtacatacttgtacaattgtactattcagtccagcatccacttctcttagtttcatgataaggaggggcattgcagcatttcctgttgaggaaaaacctacggtatgtacattatgtatgtgctgcatttttgaaacacatcacctctattgatcgtttccccctacttggacagtcaaaaaagataaggaaaagaaaacaatcacccctgtacatcctgttcgatgcatactgtacagtatggatcaattttccgcaacgtggatcaaaaatttgttgtccttcgctgttatagcttttttgtactcaattggaaggctgggcatccttctcaaacaatacagcactaaaattaataaataatctggatgattagtctgaaaatggcactaattacaagtagatgttttgggagtggcctgccagccttcatatcatgagccacaaaatccacatccgaatgttctgaaagataactgttttatgtttttgtgttaccgattttgtgatgcactatttcccctatttatggtgacaatattcgaagattgttgaaaaacagagaccagattgaattcaagataaactttcatttcatctgctatcttagataaagtttcagatgttggtcatggccacgctaacggatggctctaactaacaatatttattgccatgaagctgcacttagatgtttaccacgtccgaccttttacactcctttaaccatgcaaattctctccaccactcgtgctcttcttttcggatccatggctgtggccaaaagcctcaactcgttgactgatatgggatccctcgagctggctcgcagtgtgcctacgaaggatagtatggtggactcaatccggaaccagaaggagtattttggaaatgttggcaaacatgcatctgttcagaagcgaaatccccaacagctctccgtttctgagaatcttccagagataacagttacggtaacctcatgctcgaaagaaccaatcgccacagtcaccgtaaccacttgcaaaaccagagaatccccaacttctcctgctcaagctaatgaagaggtttcagtccctgatcaggccaacgcagctgcaaatttgaatatggccttagctgttgctgctattcccattattgcagctctcttttaacgaataaattacatcgtattgctgtgaactactgtatgtactgtactgtatgtactgtattgtactgtaagtaagatggattttttattaaaaatcatgcattatcgtaacttagtgtcggggagtatgtactgtacttatagtcagtacctgtaccgtgagtggtggtgatagaacttcatgatgattaaccacgaaacgagtcttaaatttgggtctgggcctgcgtcttgtgtgttggagaggcagagaatatgtcgtgttatcaaatcgatgggtaaatcttgggcttgattccagcagcaacttgaacatccactcttcgatgtttcagtctgggatggtcaccaatggtataaaactcatttgttgaacaggtaaggtttcactaaactggaagtgtatgtattacttctggagcttccaaaatgaatatctcactacttttcagtcttgtcagaatcttcagcatcaaacatctgctgtagtaaggctgttaccttgtctttcgttagagctctgaacccatcgctctccacaatctgccgacggtgttgatagcaccacatggcaacagcctggctagtgctttcatttccacaatcgtagatacgttcccataccagaagggcctcatcaggactagcaaatagtggtcgctgaagatggttgaggcatatggattccaaagctggtagacaatagattcgggcaagagtaaggacaccagtcatgatttcataattttggtatacttctgttcccaaactgtcagtgtacagccatctgagcagcggggtgatccacctgataggttcattgatatgtagggttctgctctgtgcctctgacatgcctgaatcaagaaggctcttaaaatatggccatcgagccacaagaatagcagcatgcactttaactgcatgcgatatggtcgtttcttcgtgggggatatcggaatcgtagccagaggagtaggaatcagagttgacagggtggggagagcctggattgactggatacggtgggggatggtccgcaattgataaggataccgatggggaaatgctggcgtctcctttaaatttcttcttccgcgaggccgtaaatcgagaaaattcagtattacccttccacaattcgtcttgaagaccagtgatggcaaaatcagaatattctcctgagtccagaagtgtcgaaaaatcgctggacatgcccaccttatccgttattccgtggccgtctatttcaccaagtgttacaaccaacatatgtgtacttgttcgatcaaatacatcagttggagcaatggaatcaggaactagagtaccccaaatgacagctttatcgtcccatgttgcaccaccaaaccatcggtaatccggaatatcgtcgtcgtcgttaccatcagtgtcagtttcaattggatcaagagggtcatttttccaggccatttcttgtgtgtcgaaaattgacaaagtcacatttttgcttgtcatggcctcagaagaacaattgatgttatagagtcgatggttgtatgccccagaaacgttcatgccaaccttgcagatattagggatcaccctagaccctttgttgatgatggctgagcttccacctcctagagggtctaaattgaaccattgcacacggtccttgctgagatttgacattaccaaacctcctaaaacccaaagccggttgtcgataattgtgctggtatggtcgtagctagtaagagaaatttcaggcattaaggaccaggagtttgtgatgagattaaaacacagagacgagtcagggtcgctcccaccagtgaaatacaggcatgtttcatcagatttcaaagctgcagaatgtcgagtttttccatgcggcgcttgcggcaatatcgagctatccacccacgcccctctctttgtatgaaacaagtagatgcgtccatttaccgacccatccgtctgttctccaccgaatatgaaaacgagaccatttctcagtgtcgtagccgtgtgattacacaatccaggaggaatcgtattgccttgagctgcaggagctgcatccattacactccatgtccacgtggtcaaatcgagcagatgagttttgtcgctgacttcatctgtaaaatgatcgaagcctccatgcatgaaaagcacggagtttgagacagaaacggcacagttggctaggagcggaggtaactgaccagagcacttgtagacactggatctgtggtttagcgtttggggaataaccggagttggaacagactgtggcagattcatctgttgtatatattggaaggaacaacgcttcggttctcacgttgtttctaatgtcgatgagagggccgggtaaacgctcagatgtgcacacgattatgcgtgtagttactgattgaaaaagtttattacatatatagtatttatgggttagggctacgcatctgttttttttattattttgtattgtagggctgtctaaccgcactttgctcttggagcatacaatctacgcaatatcttactgtacgcaaatgtcaaatctattctatatgatacagagcctcataaaatagtgcagtacgtacaatacgagtgctgcgagcccgagtaggagttactgcggagcaggtgcagatgaagctttgtcacttggggtcgctgcggcgccgttagcagcaggtcttttggttcgggttcgcttcttcttggggggcgctctttcattgccattttgtatcgcagcactctgattggttgtctggggaatatccacggcaggctgtgactgtggttgagatctcggcttggatttagactggttctctttacctggttgttgtttgagtctcggttctggctttgagtcgttcgcttcagccttagagtcctttttgggcttgtcgctcttcttcttttgttttctattagtctgagtatcgcgcaagtctttgggtgtagagtcacccaattctcgaggagtcagtgattcccgagaaggttcacgtggagcaggggactcccgcgaattacgcgagtctttgggctcacgtaccctcttcttcttggttttcgatttaccttgagtggaggtcgttgaattggagttgttaggggctgctccaattgtggagattgcgacagaaggaagggggggttcaacattagatggtacagagtcgcttgtttctcgcgtgcctgctgatggtgctgatggtggcgcagttccattagctccatcactagttactagcttcttctttctggaacgcttcttttttttgtcctcagaaggcgtagattctctgctagaatcatctgaagtcactctcgtagagtccttctccttatgcttactgtcacgcttcgaatcgtcagtcggtcctagctttttctccttgtccttattacccttcttggtcttcttcttgttgcttttcttctcctcgggtaaagtgactcgctcctcctcggggatgtcgatcttggccagaggaactcctacgggaacgatgctacccacctcgaaatccgtaggggcgatgacaggttccaggattcgtccttccccaccctcgaacaatagttggtctggattctcgcaaaatttgatatacagggggtcagattcgattgtgcctgccatgatgtcggttgtggtagggtcgggcgtaaagtaatatagaggcgaatattccacctttaagggtgtaggaatgttatcggaaatagtttcagtgtcagatttttcgtcggggctctggctccagttcttagcgataacgacatctccgttaacgctggcatggaatttttgaactccttctctgttgtgtagctggacatacactcttgtgcagctctcggtcaagctctcttggtcgagatccaagtctagaccacccacaaaatcttgccgaataagataccatgagtcgacaagttcttggaacggctttatcaaatgtttctcaacttcctctgaagacacataatcaggtacccctcgtaccaggattctcagccggtcattgtttttgggttgaccaatatccgtactggggagttgatccaggaggccaggagcggcgggtcgaggtctctgagcaaatcgaggaactgtgtctgccttcacaggcgcaaatatttgcgaacggtcgaattccattatgattgaaaacagtaggttgtgtgatttatcttggtcgtgaagatagtttgccagcttagtcattgagcttatttgagtcaaggttggggttgtaggaggagcccagcttaggcagttctaagttgtacgagtaattactgtacagtagtgttagagctttcactgaccagttcatgtaagttataagtaagcgagttgggagacgatatggaacgctctcttcttcaacacacttaggattgtgtaagaccgatgtacaatacagtacatacgatacataagagcgttagaccgatggtctgtttgaggtgttacttgcacttcgactatatatcgtacgagtgctgtaattatatttttgcagtgtgtgaatgcacgttgatgattccttcaattagctaatcatacaaagatgagacaagaaagagacatccgatgactggcgtccgatcattttaagaattggatgttagatacaatgtgcctttgtatttttttttctttcgaacagactatagtactcgtagcaatattccaattatttaatttatatagcagtaattatcgcactcactctcttcacgctctgtcaacacagtttataaggttcttacctgtgaatcaaaatcgatcaatcattcggattgtctatgagcacacactatggtacagcaactgctaacacgactggcaggactcacgaatgacgaatcgatagatccagctgtccaatccgagaagttggcagaactgttcacgccgctacttctcaaccccaacactgccgcactacaggtctcgatacagaactggactgatgaacaggtctcgaaatctgtcgagcaggcccacctgtttgatggaggatggggtggtttcgagcagtttgtggagagctacatccgattggttcgtgacttcgattcgctcagcgagtccaactcttttgatctggtagtcagcacctttacagacttgcaagtggcattctcctcagcccgtggagtttgcttaacccacaccgtcgcgctatgggcacgaaaggtggttggaggagctttccagtacgataatgagcacaacctagctcaaactacagccacgacggaatatccaacatctgaatacattgctacaccattattgcgacttttcaacacaacgcgaacggagcggagtgatatggagttcactaggaagagcataattttgcatttagcatgcttgctctgtcgagtatatttccacattcgacagcctactttgtgtgccaacgtgttttccaacatgtctacggcaggcatccgactcagtgcataccccaaatcgcaacaagttgaataccgattctacctcggcaaattttactggctcaagtcgcagttaaaaaatgcgtacttacacttgtactggtcctgggacaaatgctacacacagtcaaccaataagagactcattctcaagcacctcgttgctgtttctttgcttctgggtataattcctacaagagaactgctacagcaattcaacctcgacaacatttatggggaaatggtggtggcactaaagcatggaaatcacaccaggttttacgctgctcttgaaaacgcacgcgactggttcattgatagagatctctatgttcttctgaagtcacgagccttcacgttgcttgatcgagggtctctcaaggtcatatatgagtggtcagtcgcacaaggaaatcctgccatcgactacgggaccgttgcaagaggtcttgattttgctacacaaaacggtggttacgcacagcaagtcctggctcctcaaatgatgggaggaggtagtgccaaattgacctcgacgcaggtagaagcgattcttgtggctctcattgaccaagggtttatcaagggaaaacttcaagctacgggccaacgactcatccatgcgaaagcgaacgtattcccgccagtgtgtgttgttttgggatcacgccagagctcattgaagctgaaggatgatgaacactggatggagtcatagttcccacaagattgtaatgtagatatttatatgaccaaataataacataattcaaacagaaagtagggtgttcccatagaaatgggcgcccgtatcagtaagtggagttagttttgaagctctgatactaatggaggtgcatttgagacgtgcaccatttgattaaggtttcgtgatcaagatcatttcccctggcactatcacttctgttaggtgagcctgtagaccctgggcgaatattgcatacgacgcgttctgcacacggtgagtattcagtttgattctactatgatcgactctaacacataagggaggacgggacatctgagtctgaggacgaacagcatatttatgacgaaacgagcggcacccatacattcaccaatggctgacagagtaccacgacgagttaatgtcaacctgccgtcgcaattacagggagatattgagattacgcactccagtagtacaacggcagcgactccaacaggtcaatccagcactgctagcatgtcaaaagatggagaaccaaaaccacctgcctcatggagcaccaaccaagcaggactctcgtcgagggtacccccaaaattggcaacatcaccattaaaatccacgtctacgggatctcctaaaatatctccagcaaagtcacccttgagaacggcgggaccgagaccctcggcgccttcagggattgatactcactgttatgcggctactgagcacgggactaacaagagtcgagatgctcttgtgtccgaaatgctttgggattacctctctgggaatccgatcctccacaccaaggtacagaaggtgcgccatgatatttccaacctgaaaatggagtatagaaacggatggcatgacccaaaaatgattatgcacttgttcgatatggcctatgacgacagaggaaaacatgccaccgattttctacacaccgctgggcaccaattgcagctgatctggacgtttgatccaacactaacaagagccatggaacagacaggcgatggcatgaaagacatcatctattgctgtctcgcgataatcaaaaagaagcgtccaagcctaacactatccgaagttgtgaggcagatcatcaatgcgatgcctcagagaatagatggcctgactaaatgcatgaatctcgctgttgacgttgctaaaaaaccgccttcccccggctgggaagaactgatgatcaggtcaagtcggcacggtggcttactatcgttacgtcccaatgaaagcaagattgttgctgatggactccaggtgctatgtgatagcccctggcctcaaatggagtgtgtgattattggtgttgttgaaattgtgatgtctaaaacacagaacaagttcacgcctactcagattattcaggatatgatgcggttaattggaaattccaaagtttctccaattttgggctccagaaacccctatcagcttcaatgtaggctacaagcaacacttctcgccttgaagttcatggaaccactgctattctccctgccggacgtgaaacccggtaaaaacgttaagagagagaagaatgaagaagctcgtgctcctataaagcggcatttttcagaataccgacctaatcaactcaaacgatctgctggcccttctaatgctacagatgtgcatgtctctttgacttctgtcggaaagccgaagctcatctctcctagaaagctgagaaccctggaaattgaaaccaagctggcggaaatggcttgtaaacgcactataagagatttcacaggtgtcacgccgtctgttaaggccgttcaggagcaaaagacggtagctactgcaccacgaccgcgaaagccagccgaaactatacctacaaagctatccttagaagatggagagactgcgaatggagcgaaattactaaacacccacgagatagccaggtcatctacaacggagttcgcggcagagtcagcctctggtgttgtctcacagagccgaaagtcgttgtttgaagacagcaagcggtttgatttatccgccaacatgtcttcagaacaacgaataaacgaagaaataggggatcttctggataatgtctcttcgaacgagcctcttattcctccagcacagacaacgatggcgggtgtaccttctgttcccattgtcgagcgacttcatgctccaacttctgtatgcataaaggaagagtctaaggatatcgctttcagaaacagtgccaagctttcagtaaccgacgcggtagccaaaatagcccatctccaacccggagttggaaagtacatcgagtctatccaaggtcatgacccgcatgtagctaaggcatttctggttcgcttggttatgagtggccaagttgatgttggcactacactagggcacgtgaaacaactgaaaatacgctaccctcgccacgagttcttcttttcacctaaggatgataaactgctactacagcttatgcggggagccggcgcgaagccctccaagctcaatcgtctgttcaagaggcatctctcttctgatattgacatgcgaatgaagttcctaggctatctgaaaaccagaaaagacaattaacgatcgatggacttgtgtgcagtgttttattatcaatacattcactatacaaagtaatcgtaataatgagcagctgtcttaacatcttaacacgtgttcttggcaacagctgtgctccaattcaagccgtcaccaccaccttaccaactcgttcttcactcccgataaatagctgcggacgccaagccatttccatctgataacactgccaagaattacacctgcgcaagaaaacacatgatatttttattgtatgcatcaccatgctaccccgcagtaatgacgttacaatgtatcatactgtagatacttagctagtgtacatggacagtagatacgatccagtgcaggttgagcctgggaaagaactggctgatacgacaaacgcaatcctctttgaaacaggtgacacgctatatcggtatatgcttttggcttatctcacaacgatgagtcgtccgtaatttttcaacatctactgttgctatcattaccgttacgatggtgcatactaattctgtttccggaagattagtctagtctaacgttgccgctaaaacccctgtatggtacagaacagtaccttcaccacggctacagtacaagtacagtaggacaatgcattacatgggcatgggctggaggtctaggcggggttacgcagctgaaaccaatggaagagcagaaacgatatatacaagtacagtgcaaaagatcagagacacagacaatatgttgcattaaaattttgaaacatggcgatgacttatctctctgtgggctagtgtttcaatgaggtaacatcctggtacatggaagcaccaacatacaaatcacgacatgcaaccaagactaacaccaagagtcgggaatgtccaagaatggtatgaccgagaggaaatgctgttttaagaagtcttttcatatgcaacagagccgtatctgaaagcgcaatccatgtgacattgaaaccaagcagacaagagggtacgagagtgtgattgttccattatctttaggggatgtataaataccaagagaccaccaggtttttagacataaacaactgcaacagccatgaagttactctctattcttctctggatctcaattggtctctgcgcggccatcccccagctcgaaaatgactatgccaaacttctgagtctcatggagcatctggagaaacgaacaatgccccatgaaaagtctgaaaagtctgaaaactcaactattgtcttgttcagtggaaaagcttctatttcagaaaagctagctcacgttggatccttggtggataagggcatccttatcacaaagctctacgatatctccaacaatactgcaggaaacggtgtgattggttacgttggttcttttactcaaagagaagtacagtctattgaagactctgatactattattgactctgtgtttgcagatactctggtctacgctcagggccagctggaggagcgtcaggacatttacaaaactgtgaccaaccagccctatcacctggctcgtatttcccacaaacagaatcccaaaggcaccactgaggcaggaaagtactcttacattcaatacactagcttccctaccaacatttatgttttggacagtggtattcgaactagtcatgaagcgttcggaggaagggcccagtggggtgcaaactttgccgacgacattgatcgcgacttgggtggccatggaactgctgtagctagtatggcagcagctgtatctgtcgaatccactatttggggtgtcaaggttctgcaactcaacaccggagctctctcctggatcatagctggtctagaatggtccattaaccatgccaccgaaaggaatcagaaggctgtcattaatatgtcggttggaagtggcgctgttgatatttacgatagattcatggaaattgctcaggagcgaaacatcgttgttactgtggctgctggaaacaacgaccaggatgcctgccaaaagtcccctgcgaagtcgtcaaagggtaatatcggagtctacacggtggggtctacaggagatgaggacgttcagagcggcttttccaactggggcgactgcgtcacgctgttggctccaggtgagggtatcaagggagcatccaaagactctgataatgggtatctatactggacaggcacctccatgtcgactcctattttcgccggtctggtatcctattggatgtctatcagtgacttggattacgccaacctggaatacttgctcacccgaaataccggtcttgtcactggtcttaagggtaacactcccaacatcctggcctggaatttgcacacgtagtgagtggacacatatcgtgctggctcacggtattagatcatatgttactgaatagcacaagtacattgttacaattgtaataaagataaataatatacagtatatactgggttaccacattttctcgctggccttcttcttcttgttcttcttctccagcatcgcgatgtgggcctcatcgtccgcaactaccgtatggggatgagtcttacatgcctgatgagtgcagtaatcaaccgtctgcaaccatgggtcattccatgcgtcggaaatgtcgattcgctgcagagggtcaacatgcaacatctggccaaccagcaaccgcacctcctggggtaggcgcgagaagagcttctcagcgccagagccaggctggatatggggagccagattgaggacaggggaagtacttttaaccagcttttcggggttactggccgagcgactgtcagcagtctccaagaacaatttgaacgacgaatccgagagccggggagccttccaagggaactttcgcatcaacatgcagcaaaagacgattgcggcagaccaaatatcggcagggcgtgggtcgtatttgacattctggcacacctcgggagcaaggtatggatcggaaccaacgattccataggcctcgtgaatggtggaagattcgggatacttgaagattgcaacggagccgaaatcgataatcttcacaattccagaagccgtaattacacagttatcgagtttcaggtcccgatgagcaagacccatgtcgtgcatgtatttgataccggccatgatctgcttgaaatcgcagtaaacctcctcccgagtcatcttaccgctcatcacaattgcgaacaggtcgtattcacagtactccataatctggtaaattttctcaccctcgtagatgatgtcgactgtctcgacaatgttgttgtgcttaagagtcagtccgatgcagtactcgccactaattttctttgaataatccttttgagtctcatagttattcttgcggcggaactccttgacggcgaaaatcttcttgtccttgttgcggctcaccagacgaacagagcctccagctccctctcccagggcttttccgggcttggagtaatgcttagtgagcgaagtacgtcggtcgtcgtgcagagatctgattgcattggaggacgatgaaaaagtcgatgtgatggatgaccgggatgccgatcgggctcgtccggacgaagacagggccttaagattaggggtagaggagtgggatgactgggaccccaagctagaaccccccatggtagagtttgacccgaggaccggcgactgggcggtcggactagaggcatggctaccatcgggtgcggttcctgtaacagcaaatatttcaccgttgtcgctggggagcttattgttgctagaatgtctccagggcttttggaagaaccgcttgaggtccgaagttgatccgtgagagttggacagcgatgcagatgagcccgatgagggcagagggctgttggaggccataaggtcagcttgactgtcttttctcgatctcgagaaaagagacagtgacgaagggctcttgccgaatgacgagccacctggactatctcctccagaagatccgccgagcgacagccgagacgtatccacaatgaaccgaggttcaatgtcgcactgctttgtggatgacatgcctctcatgaaggaggttccagcaattccgggttggataccctttgcttttctgggaggagtatccgaggcgctgtttccgttccacgactgttgcgctgctgctggagatgagcctccaagcgagaactgagccttgccgtggttgacgccgttgtgggccgtttcctctgagtgtcctgaagtggagtagtgacaggtgtcctgcgaggactgggaagttgaataggtcatgtttgcatctgtgggggctggagatccgcccggttgcgagcccagcagtttgctcagcgaagacatgccagtggtgtgtgtgttgttgttgacactggtcatggtgtcgagtgctaatacagggagagaggaaggccgtgccatgatgatctgtgcgggatattagtccactgagcttaatgttaatggctagatgtggtggttttgtagttggtggagttacggtcttgtatggacggctgggacagcttgtagctcctcggagaggctgtagtagttcccataactttctggggcttcgccaagcccccaactgttgtaatgacctaatgctccacacccccccacattattatggcatctccagtcttccccacaagattgctgtgtaagataggacccttacaacaccaaagtggctatattacaagaaactaaatcgattataaaaaccataagatcagattctgattcaaattccttgctttgtaacaattaacatctacaacatcacctggttctcctggttcacaggttcaaccatcgtctcacctgttagagtttcaactcaacttcatgacaaatggactatactttctggatcctccaagcctggcagccataaatcaagaaacgggggacaaaaaattagggcggaggggggattgttgcctttccgatctctacactatcccgatcgcataaacttccacgtgacgtcacaagacagctccaatcctttcccggtcggccagaaaaaaaagacgttgaaagcttaaaaatgactggccgggaacgcttggtcgggaataagcggatctaaagataatgatgtagaatgggcggctacgcgagcttgggactgtgcacgttctacagtgagcagcacaacattaaataccagccgaatccgcgagtaaaaacagtcttcagaatagctacaagtagacaaaagagctagacctggtccccgaataaactgcaccttccaactaatgcaatataccgcccgccatttggtgctgtgcttaccagtttcaagtggactaatcttgccctacaagtacagtgaactgagacaagcagccgagtttgcagctgacccgaaattacaacttgcacaatacctacagtactgtatgtacattggtcatttatggcgtcgtcatggaataaacaatgtggagtttgtggtctcaccagcaacagattcagactgtccgacacacacattccaggtgatatggctggtctgacgtcagtgttgactgttttggatccaaaatcttgttcgtgacattggcgacacactgtaatttgctacacactttgtaatttgcagtggtaaaaggtcaagagcaatggcttcgatgacaaggcgggatggcggcaaaacacggcagtcaaagcgtacaagacctgtatgtactgtagtacacagcagtaatatcctcgcgcattctgtacacgacttggcatcattgcttccaagcagcatgtgcctgactctcattcaactcatttattaataatagactgtggcatttctcggatttacaacgttgtacaaaataacctacaagtacattgtacgtaaaatgtacgatatttgtaggagtgtagttaaattacttgtacagctaccagcatcgtaaccacttgtacaagagaggggacgtacgatatgatacgacagtactactagggctattttcatgaacaaatatagaaacagcgaaaggccatgtggtatgtcggaaaatatcacccaagttgctcagatacgagtaaatcagattgtattgtccacatgcgcagaattgggaagcacacgatctccgacgctttagagttcattaatttcagtacagtatgtacaataaactggtacgaggacaagtaggtggtacactataagctatctcaccacgttgaactctggggatgatattcttcaagattgcctatttatggacgtttcacacagccgtatctcccccagtgcaatccatgtggcttttgttgctattatgtcccattgccgtcctccaagcagaggctagacctgatgatatttagctcgatgtctgacttcatgtcttagatagctcaatataggagtgtaaattgaggagtccgcatgggcaccatgttgtacgaatactgcacttaagcgaaattgtcaatgaaattacttgtgtgaaataccatatcatagttacaaaacacagtatctactatcgtacgagagggttcttgtactcgtatgtcagtatggtcccgaccataccgtgccggctatacctcatctctgctatttttgtcccatcgaacctgtttgcttttttcagaagtattgtaaatactggggttgtaatcttcgaagggaaataagaaattataagtagtatgtactgcaccggcagttttccaaatgttttaataactcattcaaatatgtgcaaatgtctatattagtgcttataatctgtcctctaacaaacagaaacctcaattgtcttcttagccaaccgtccaatctcacctccctcctttgccaacaactccaggccgtggtgaagagagcccaggtaggttttgagaacctggtttctagcctccacgtcctcagtgatggaggtagtagtggccgaggtgtttgtacttttgaaaaggttgaggtgcaagaaagggtctgagttggggggctgtgtgaaaagtctgctcatggggtggaacagtggattttcaggctgtcgttgttcaatgacgacatcgtttccagaagcatccagcagtttgatctccttgtatttcacaccaaactcgctgagaccacttctcagaaacaactgtaggcactccaggaatgacttcttcacactagcggcctgcttgccgaacgccaggcctgccgtgactgaactggagctcatggtgagttgctgatcagtcttctcatgggaccatccaaatagcgcaaagaagcagttgagtgtcttggcccagtactgacgctgaagtacagagcagatggaaaggtcgaaagagtggctgaaagtgtgcgattcgccagtagcgggggtcaccataaggagcaggaactttgtcgagtctgctcgaatatcaggagtaatgtgagtcatggcggaatggatgtacagagccaagttaggaatatgcaacgaaagcggactgttggcggtgtagaactcaggcttcagagtgaatttgggcttactgatgtcactcagctgattcgcagggacaggatcaacctgacccggttcaaaacacagagctctcagtagcaatagcaactctgctcgcaccttttcagaaaggtcgagaaccagcggagcggctgcgtcgacaattggcttgatgttgacgccgagatcgtcgctgctggccaaatacttgttccaggcgtttgtgagatagataagagcctcttttcgagtaccagccgagtgatgcttcagcaacaaaatgtgatgcttaaagtcttcgttgttcagaggcgatactgtgctaccaacagggactcctccagcgccagtgatgcctttaacgatactctggttcggcagggagatagtttttgctttgaaactgagatccgtgtgtgtgttgctcttgggagcggtctttccgaccttgagcttggtcttctggaagtcctttttcttctccttcttttttcgtgctgataccataatgtttgataatgatgatgagatggtgatattttttgtgtgatccgcatactgcatgcatgaaaacactgcttctgccactgtcgcgaagacagacaaaaccttatctgccagtgtgcgatccaggctgttgaaagacagcttgaagtacaagtacagtatgtacataatcggtagtagtgtcagtgcaatgaatatgttacctgtagctacttgtagggtttctgttcgaaattggaaagaatgaccaatttcagggaaaaaaaaaatcctcatatcgccgtctaagaacatatcacccacaaattaacagggtcaaataaatcagctactccacgcgataaattcaatatgctgttttttgaatacaattatactgtagtagccctcgtctctatacttggacacgttgttgacagccttgaaagcacttagtaatcatcaaccttaacgcaccactgcatcattgatgccaccacacaaaaggacatcaacgacaagacactaacatcacgaacatgttgcctcaatggtacagtacgcttactaccaagccagtgtgagtatttccacgattgtcgatggcgtgattcttttcactaacgatagaaaaacacttaatatcgccaacccacagacgcccccctcgttcggaaagagcggaaagaagattgtcagcaagcaggcatccgaacacgagcaggatgtcttgaaggtcaagaaggcatgggacattgcccttgctccgggaaagtcgctccccatgaacttattcatgtcttacatgtctggatcgtctctgcaaatcatccccatcacaatgactgccatgatgttcttcatgactcctctgaagtcgctggtcacatgccacaagcagtttgctagcttaatttctcctaccaacaagtcgcagatcctcatgtgcgaggtagtgtatgtcctgattctgctcgcaactatgggtgctggagtgtggaagcttggacaaatgggcttgctgccgaatacccgatccgattggttagcttgggaaacccccagtgtttatctggaggttgttaatagatgatgggggcgatggttacggtatgagaatagcatcggtcctacagaggccagtgcactcacaggtttcggatccgacaccgtcagttgtcgctgccaccctgctcatataaaaaagttattactttgaaaatctcctacattctctgtctttttatacaatcgcgtaatctatcaacttcataggtgtcgagagagacctatcgtggtgtccatgtctgcactcatacctgccgctcaacctccccaactgtacagtacatacagtaactgtactcgtagatgatgtacaatagcacactctacactacagtagtactaacttcaagtagcaactgaagcgagaaaaaaaggctttctagttggtatcacctacgttctttggcggcttgggcttcgcgtccttttctggtttcaaccgagagcctgcattcaagttgcgcgttcctcattcatgagttggagttgcgccctctacttgtaccccttgttcgttatgtacagttctgtatattcggggcagcagctctcttctaaccggcaaacatcacaacgaacccccgcaccagcctggcacagcagtttcggcaagtctgctgctgacaaacatgttcttggcgacaaagttgaataaatgattgtacttgtatgtacagtacatactgcacttgtagttggtgattatgtttactcttcttcatcgtaagtgatattctaagacgttatcagctttcgcgggcttatgttccagcagagcagggagagcatgggcgtcgagatacaaggtactgtaggcgtagcaacacaagtactgtatgtactgtatgtactgtacttgtacttgtaagtggcaccccttggacatgttctgcttaacatgtcaaagagtattagtatgtctgctggaccagacacctgcttctgacgtagctctatagtatgtactttgtatctcgacaagaaactacgtacgagtacgtgttgaagtattgtacatacgtctaaagcatcgccgactcataaaagttcatcacttaattatatacaagtaactacaagtagtaactagcccataacaatgtcctcgtagacaccctctgtccagtcagaccaggctctccacaatccttcttcgagcttcttcacccactgtttcgtgtcaaataatcgtccagtttctcgctgactatacaataattgtctgtatttgatcaaggtaggcaattgaggttccgagatcagacttagagtgttgttgacatacttctgattggagtcaaccacaagatcgcggtacatagcttcagcttctgccgaaggaggatgaggaatgctggcggcaataatgctagaagctacccgtgacgacattttgtgatcatgcttaggaaatgtcagaattggggttccattccaaatcacatctgcagctgtcgtatgggcattgcactcaggggtgtctaagaacaggtcgcaaactcttgatcgcgtgacgaaaacatttttatcagtgacgggcgtgaacaaaattcgcttgttgatatcgtcagtcccttgataccacttcgaggccatctcccggatcttactctctccagcgggaggaaactggagcagccataggtatgcattgggctgtcgctgtagaatcagaagccacatgaagagtgtctcgggtgtgatcttgtacagctggttgaaacttccaagtaaaacagcctccttcggaatatcggggaagatctgttgtctcaacttggctctcttggaaagttcgtggtcaaatggaggcagacgaggcgtgccagtggagtctccttcctcctcaatgcttgcatcgctgcccctcttatccattttcgagtccaagtctctagagaaggaatcttcccattcgtcttttttgccatacaaatagtcgtcgctggagtaaccatcaaccaaaggggagttctccagctgagaaagagcgtacttctggatatcaatgttgctatattccattttgtgggcagatgcaacagtaccagtaccacaagaccgaggtgacttgggcttacgcaccttgctgtgaaaacgagaaaggctttcagagagagtagaaccctgttcatacatctttccgcttccaacaggagctcgagacacgctctttctcactgcaaagcaatctggggctgtctgtcgatggtcacaacagaagaagctgggctggcaaatgatcagtttctcgctgaaagagtctcgctgtctctccctacttgaaatactgtctgaaaagatataatctatccatcctgctcccaaagtaccagcatatcccatcaggctgacttgaacagggacaggtctagccgcaaagatatcatttctggctccttttgtgtacccattcaagtttaccaagatatggatattgtccttaagaatagtctcaataacctgatgagtggacatattgctaacgtctctcaccagggcctgcttttcaattctatgacggtaagaagatccatccgacgaagtggtagcataacaaatcggcctgacttttgttgtgtcatggagaccgaacacagactgcatgagatgggccaaggggtgatcgacgaagtccgaactcacatatccaacgttgagaacacctccattctgcccggggctctttgggggtttgaaaacatgtcgaggcatccagggctggcgtagggtgcttacagagatccgcagagcagtcaattgagcaatgcccaacacctgttcacggtccagaggtagcgtgaatgtgtggaatgggcttacagttgaggctgcaggaacgtgtagcaaaggggggatcttgggtcgcggaaatttatcagaagaagcatcaggatcaagataccatctcagttggcacagtcgggttgcttcttcgatggctctgacaatctgggtcccctctcctcccaactggcacttcggggacaaatagggcagtagtttgttgattatgtcgttgtccaagtctccagtggcgttggtgatgtcttgagctagagaagggctcttgtagacaatgccatggccccagatctttccgtccttgagctgctcgttaatcacgccaatgagtcgtgtgatccagccaggggtgttatcgaagcacaccatcccatcgtcgtccactccacagagttcctgaggtgactttccgcgccctgcccaagaacaaatggtgctgagacaatttgccagtccacatatggcctctgcgaaaccagggttggctgccacagccttcttgtagtactgaatggcaagactggtttgtccgttgtcctgataagccgctgcaagattaccgagtgctgtgtcaaaaccagcgtcgcatttaacggcgttgaggtacatgtcgatagcaggtttaagtcttccttgctctttgaatagtgagcccaagtttgtgtacagatgggggtgtttggggtcgagggagaggccatattggtagtaagaaagggccaggcttctgacatggtttcggttgggcatagatgtactgagagagttgagcaagattccaatattgttagcggtcgaagctgagggattgagagatagcgataataaatacagggaaagaatgtcgtataatgttggggagcggttgttgaaggagattgcgtggtcggtttttcccgagtggatgccgtcctgtaagattttagccagattcaacagtgcattagcaatggtaattgtgattgattggaacaacggaagaacagaaggaggaacagtcacacggccattgtccgaatctgacgaagctagttcgtaccctgattctctgtccttcgtaagcctaccaatccctggacattgcagaagtgttaggcggagcagcaaagggggcaaacccatgtctccgtacagcttgaatcgaaccctcatggccttcttggggctcactagaagcgcagaggttgttgaaaccggaacgcttgctacatggtcccgctcttccatgtaccatgccagcatgacgtttgaaatggtttccgtgagcgtttcaatttcggatgtagcaagatcagtagatttgccgagtgcaaagttgaccatgaatttctgagcatctactttgctccatgagaactgatcaggtcctagcttcaaatgatctggtagtgacgctagaattacgacctgtgcgaatacctgcacggcctgacctacctttttgtgactgtagtggttgtttccgagggtgtggtaaagcgacagaagcttctgccacgactggagagtgttgggggcgatgtcttgtgcgatcgtcgcgttgatgcaggtacatagtgtggtaccagcttctataggtcgagattccgccatcaaaacactggagagttgctcggcggcagcccagtaccctggttttgcccttagcgtcattctccaccaaaatactgcgtcctgcttatgcccggctgtaatcattgtagttgcctggttgtaaagggcttccgcgtagttgggtgcaaatagcagaataacagagttgagaaaggcactcttgtcgaacagcttcatagagaatgccatgcaccctgcgaacaggtatccttccaaggctgttgtgtaaagtgctctgagcttggactcgtccaaggttcctgtccttgggatgtctgtgataatagagtgcactgtagcaatgaggttttgatgtcgagctgctagatctccattggagtagaagggttggatttctgtgttagtcaagataatgagggcaaattaattaacacctagagatgaaatgacgaacgaaacataggaaaacatgacataaaccagaaagggcctttagattagattagtactcacgtgagtcttcttccacgacgcagtcgaaactgtccagtatcttggagggtgtggggtcacttgtagacaagctgatgacaccatccagcttggcaaaagtcggtagcggatatggattgtgtccgagagagtgaaggtcttcggtggccgttatgatatctaccctctgagcaatctcaataatgactctgcgactccacaactccagagtcgtgaccacggcctgtttgactgcgagggagacttgcgtcgatccatgcacctgctgggccagcttcagcacgatatcaatactcggaggcattggagtgagtgtgtcggtaaggggaaagaaatggtgatattttctggtttccgcatgaggcgagaagccgtattcaaaagcagctcactgggactactactaaaacgtaggggagcgttccgcgaacctagaattggcagatagagcttatttgcctatcgcttgcccttttgtcgttaccttgctcgcgtcaggcgcagcgctcgcgtctaactctttttttggaagcgatggtgtgacttcaggccatcagagatcggaatgagcgaggaaaaatctaggaggaggcggggacattatatatttgccattttattactacagacaatacgaagacatgtttgaaatggctaataggttttttgtgagttggcgacagctgtccaaaagtacattgctacttttagatcgactctaaatattctaaaaagctagtagcaacaaaagcagtcctggacacaaagtacgctaaaaaaggcctcagaaggaaaaaaaaaaaaaaagtctcccgtatagcttgagacccatgttctgaatgtataccccttggtgccaaaatacggggtcagcactcttcaaagtccaaatttcattcaaactttaatttccccagcccaacctacaccgttaaactacatgctgttgcgtatttgatgtctggtgtgtgtggtccaaataagtataattacgtcacacatcattgccattgttgctgtggcaactacggtttgatacaacggaactctttgtgctcgtaacctcgtaaacgacgactccgacgttcataaatacatcctattcacccaataggaccggggtgagatggatggcacggatcagtacagtactgaccatagtttgctcgagcggcatcaccagcaatcgaagttcaacgtacactctgagcttgcggtggaaaccacttgtaagtttgttatcacccccccccccccccccccccccattgatgtgtgtgcgattgacttggcatgtgaataacgtgcaggtacaacaactagatgcaatggcatttatgagagttgctcggtttcgtgagactgaaactctctattaaccacaagaggtatgatcctacttgtagttataaaaggctgtactgtacctgactgttattactattgctgcattagcgagtgttattgccgcagtagcgcatgtcttgtcattactgtacattaaactgcatcgattgctccactcacgtggttcaggctcctgctatgtagttgctagttgagtaacttgcgagatccaaaacaatcctcttgtgtaaaacggaatgatcaccccatggagttgttcttttctgtccccagtacgatctgtaacccggctctctttaactttttctttgtctgcctccacgcactttcacttgcgcttcgggcagatgtttcttttatcttctttgttccttgagatgtctggctgactgtgtacatagggagctccattacccgcttatctacccagtctccatgtcgcctacacggcacatctcgcgtatctttaacctaagaacccggacatgagcttcacatcgctgagtttactggaagctgtggggatacgatgacacttttggtgagatgaattacgagtacattaatccaggagttgaaccacatctaacgggactgccgtaattgaaactccatagcccagatctccacttggtgacccctgatgcaacggcaaaatagccgttttgagacaggcaatgagatatggttgctggtccccttcactcttgcttctcaagatagaaactcgatcgtcagcatacccgtggctgttctcaacttagtcgcctaagaacgtctccttagtggctggcctccagcaacccacttacgatacttgtcaatcgcaaaaacagttctttgggacggctcaggaatgaagcaatcgtcatacagcaggatatcgttagcaatcgaacagagctcctccgcaatcgcaatcgttcaacagcctcgtaatcgtcataatattcctagttcacttcagaagcggctgatctgcagtagaagattgtctcctaggacagttccggtttactgattctccaatggactcagggttgtggtctatatcacgaccaggaagttgcaattatgatctcgtcaaaatgtagttcgacaatggcgatttcggtgacgtcaaactatgcacccacaaaatttgtgaatgttgagggaaacaattgacattcttgctgaaagatgtatgtacatactgtactggtacttgaagcttggaaatcaggaattcgtatcaacagcttgttgtgcgtctcgaataggtataattatgagctgaaatactcgtacacgggtaccctgtcggctgttgtgttaaaagacgactcaattttactcgtactaaccagaaactaatacttgtgactaagacgtctgtgagatggactaaatagccaagtacttctaacctggtacatattatgataacaggtggcatttctggtatgtactgtagttgattaatgtgtgtcttgtagatagcagcacctattggtctggagtctccaatgtggacaagtgcacacccttctgatgtgcactaatgtacatactgtactacaagtatctgaacggggtgtcctgggaagtgggttgtacttcaagtagttattaatactcatactgtatcgtacataactaaatattaataattaataatcctacatatggttttgaacacaccatacatcccgagaaagtgctttactacccgttagctggcctctctgggaccttcacgtacttcttgttcagactcaccacagtactcaattacatgagttcgtgagccagtgtcgaggttcccatgatttatttgagttctgttagcatctcgtttccaatgtcttacgtgtgtttcaaatgggttcgaatgtcttgccacggtctacttgtagttttagatgcttgttcaattagatgctcccacatcgtcgagtatttcgttgtgaacataatgttgaaatgcgacatggagtacaagaatctttccgagtcctgtgcggtacatgtgttgtatatcgtaggtcgagtcgactgttcatcactcaaaattaccctgttgggctgcagcataaataagcatgtctcaagcatgaacccaccaaacaagtgagcatcgggaaatgcatggcgcgcaatcatttgtagacggattctagaatcacgggcatcgactccaagctacagtaagatactcgtacagcaagtcccatatcgagctccccaaatttacatcttgcaagttgaagtttatcggtgtttgggttttcttttcaagctgatagcgcttagggttacaatctaaccgactatggtaaaagaaagattgaaagagtaatgtacagtacgcgtcttatgtaagtggtagcaccacacaactcatctgtaggaacggaggagactgttagtggcgtaaaataggggcttctttctctttatttctttctttcttccactaaactggtttctctcttcttggtcttatgtaacccgtgcctccacgttcattttctagcagcaaaatgactggtgacattgctaggtgataatcttttccaattaaccacatgtctcatatagttagcccgagtctaatgacactgaagactcccgactcggggtggctacttgtagtttcgttatggagtacactctgagacgacttcctccgtactgtactgacggtcgtttgtcttgtgttgaagactgaagtagatgttacatgttaccggaatcttcattgacgcttcgtagctgacgcatggccctcttgtagatattccaacggatggtgtctcggatatctccgtctgatatgagacacgaaccatagtatgtatagtatgtacagtaaataagggggtaaccggaacttcttagagtgaaatttcaacagtgcaataatgggcagtcctcggtatgtttacactatatatgacaatgtcctttcacgtgcgatatagtattattatgtacatagctggtggtgttctgtgccagctacattatttccgtgcctgttgaatcgatgcacatgttagttgaataaataatatctcttctgtctttcctatctttttccaatgagtgtcaaaaattcgtctcgagtcttctgggcgtctctgaagcggccaagcatgcaactggtgagcgtgctactaccgctcttttgcacgcctcgggataccatacacatgtgggaggcttcaatcaccactgccactccctggggctccagaatctcccacaaggccatagccacctgcttggtgagtcgctcctgaacttgcagtcgccgagagaacatctctgcgagacgggcaagcttactgagacccaaaactcgcgagttggggatgtagccaatgtgaatcttgccgaaaaagggcacaagatggtgctcacacaacgagaagatttcgatatctcgaacaatgaccatttcgtcatgatcctcttcaaaaacagcccgcttgataacatccttgacgttgtcttcgtagccctttgtgaaaaacagcatggctcgggcgtatctctcgggcgtctccaagagaccttcacggtttgggtcttctcccagctctgtcaaaatcgtcttgactgcatctgcaatacgtccttcacgggctttggcctcctcctcagtctgctcaagacgagctctagcaccgacagaaggccacgacaggccgtcgaaatctatgggggggttgagcgtgtatgggctcgccactcgggtgttgagaggagtaccctcctgttgtccaaggtaagagtattgcgacagcttggatcgagacgatgaaacggagctagatcgagtagaaggcagggaggtgttgacggtggggtgttggggctgaggctggtgcggtgcgggaactcgtccgttcacctctggtcgaatcgtgttggtcgaatcatgtcgtttttcgaatgcattgattcgttcgtcgtcgtcaaacccagacattctttgttagttaagcgcaggaagtgagcagaaatcaagtcaactctttataagagatggcactggcgttgctttggatcgcaaaacaaatgggtatgtttcgatactcacgtttctgattgtgtctggctcctgtccaaaattaatttttcacaatacctgagcttgggactttttagtagtagagttaggctttgacccgggcacgtgctctggggaagaaaatggatgagtccaagaaaacgtttcagggctgctaaagtggcgatctaaagagatgaatcgacacttattacaataggctacattatttagtaatttatttttgctacagtcgccaccaagactttcaaacctttgtcggaaatcttcctcgtttaccccgtatactcagtgtgcatatgcgggaagcatacaggcacatagagcgactgtttggtgtacgagttcagtgcgagtcataactattgaagatcataatactacaagtaacacaaatgcacgtgtctactaggtggtatttagtatccttcacctcttataagtacaagcattgtacttcatccactacagttatgtatgtccgagactcgtacctggtctacgtttttttggtcagatattattcggctccattttattcgtccctggcaacgagacaagcttcacatgtgtcgaaaagcagtatctttcgattatgatgaggaaccttgcctggaaatggaaatactaagatatatcgtccaaccatgacgatattcgaatgatacatgttatacatgtgttcacaaatatgactcagtgttcctggttaataagcaaggcttcttttttaaggttgggccgttacgtcatggtgctaaccgagagccgcacatattgcacatatcgcacgtgtggtcatgtgatctaaaataaaaaacaaacagatgatcgtttcaaagctacagtatcagtacaagtgaaagtgccgggttcttttggaaatcatttacctttttctaattaagcagcggttaaaagtgttttatgtgagcggttaatccgatttaatgttgtatttagggtgatcgcatgtccagcagcatgtacagtacagtaatgaaggtacctgcaccatgtatgatttgtgagagtgcctgaagaagggtgttgttcgtattcactggctttctacaagtagtatgtttttggcacctttgtgtttaatcggtgctgtttgagctgatttgattttctccgtgtttattctgcagcttttattcgacctaatctcctagaattttattattctgccccttccttagtaatcacgcacagaactcaaatatcacggttgccatccaaaacaacacaaacggcattatttctcgataatggattgggaaggaaacgaatgggctgactcggaatggacgtctgctgagccggccaaggaagaagtgctcagcgctttcaagcctcttccaaaggactctccgacagcggtgctcacccctgaaattgatgatattcacgcctggggcgacgtgttggaagagagaagtagccctcggcctacctcaaaggatgccagtgatgtgcggaggaatggaggagttgaaacggatgagaagcctgatctatcagagtctgcagctgtgggtgaagcaactgagcagttacagaagatgcagctggaggaatcagaggtggaggacgacacagaggaaaaggatcagaatgatacaaagctcaatgctctaggcctagcacctccgatctcaatgtcttccatttcggtggacgatccccactggggtagtgatgttgaggcggaaccagcgacagttagtgaagcggaagaaactacagaagctgcgggaactacgggagtcacagaagtcactaaagaggcagctacagagacgttatctgatctacaaccagatttggccgtgcctataaagccgttttcgcctgtggaagtgacggaggatgaaggctggggcaagtccgatattgcagtgaagcccgttactcccgcggctgaactgcaagaaggatggggagagccagattcagcttctaaaatggcatcttacaatgatactgctgctgtggaagaagcgatgaagacagaggctcctcttcctgtcgtggaggatgaagggtggggcgatggaggagatggaggagatggaggagatggaggagatggaggagactggggtgatttcgaggagggcgaaggatttgatgatcctgggcctgttaccgaggcgactgccacaccgaatgttatcccagtaacctcagtaaagaagtctgccgttcctactacacaactcgaatttccccaacctttagaagagttgatcgttcaattgagaggatctgacagtgccgatatcgaagaggtgaaaaccgttacgcctatcctgtcgtaccgagaaaaatcgcgaaagctgtacaactcactgattcgcccaaactgtcagttcatcgagtccaagcgagctagcgaagataatgtggtcaagtggacgggatcccagtttgagagtaccctcaagggggagatcaggaagctgcatgagaatgactccaaaaatctcaagcgggtgttcaagtttggctggagcaatgggggtacggagagatctggctccagaggaagacctctcagcatgcctcctccaaagaacggtgaacctgctgtccaaatcccgggtttgtctcgttcctctacaatgtctcgtgcctctacaacttcccctgctcctccaagcggtgggctgaccagatcttcttcgttaagggaacgaggaagggacatgactcgaaacaaaccccctggactggttcagaccgccattgctggagctgtcggtcagcgggtggtctcgagctcaccctccatgtctcctacaatgtcccccatatctccttcagcgccccaccatcatcatcatgcgctgagtagtgtttttggtcggtccaagtctaagactcactcaaagtcatcctcggtcagttcgatcacttctcccttggactccccgatcgactcacctattgactcacctttgggatcacccatcttgaccaatctcgtgccctcactgtctcctacattgacaggaaccccaccaagtggaccaagtcgaacagggactccacttagtaatgcccctccagtggcagaagatagctttgctgacttcgtctccgccacacctgttgcgtctaaaaacaactctcccatatcttcccctaaaattggctctcctgttggatccccctttggatccaaggtgacctctccgaaaatgtcccatcctcagatctcgtctcctttggctggaaatggaaaccacgacctcatgggtctagatctgttgggatccaacacaaacactgccacaaaagctacacagcccacacagccttcgaatgctctggatgactttttcgggggctcaaagcctgctggaatgaagcctgccgcatctcctttggatgacatctttggttccaagccagtagcgcaccctgctcctaacaaacccgcacaatccccgttggacgacttcttcagctccaccactaagaagcctgatccccagcctgtgaaaaacagcggagcctctggatacttgggcactgccgatggacagaagtcggcaaccactgcaagtgcaactggcaaccaactagatgatttgtttggctcttctacgacacccaccaccaacgctggcaataacatgggtatatttggttctggctctactcaacctgcccataagggctctgactttgacatcttcgatgaccccaaggctaaagcgattcccaaacctgctgtcgcaagtactgataacggctcggagttcgacatcttcaacgcggcacctaccaagcagacttggcagccgcctgctgaccctctgaaggaatcttctgcgaggttgtcaggctttgaaatattcgacaagccttcatccacaccatccatccaaatcgacagcagccaagctgaagacgacgaatggggtgacttcactgactcagtggctaccacgaaccgaccccggaagaactcgtacaacagtgctgctagagtatcatccaacactcacaacgttccttcttccgaggtggcccagtccatctcgcagtcatccacgcagtctctgttcgacaccacttttctggattcggctatggacaagcgacacaagtcaaagtcgccttctcggtctccaattgctcctatgaaactggccaagaagcccgtggcattcgagcttgatatgggtcctctccagcctggatccaagtacaagcagcaatcggaagacaagctggtcaacgacattgttaactctctgcctaacttggactttatggctttcgtgtaaacaaaccatcatacacaatagaacaatgcatttaatgagaaagctgtagcatttgtatttcgaatgcatgaaaatcttccatgtcactacgagtagtccgcaaatttagacgtctttggaggtttttcatatccaacctgtggcatatccaaagcttatgttgatgtttcaaaatgcaagcgtgtattcgatgatattgtaatttaaaccacgagcatgaaaaatgtgccccaccaaaatccaaatccgataatgcactcatggcatgtacgcagatcgggggatatacggatttgtggctgcaagagttggaagccatttttttgtggcaaaaaacgttggctgtctggttccaattattattttttacctcggcttacagtgatcggcatgattataacgtgcgataagatgagatgacctgcaccgccccgccaccacaaccacgttctttttttcacgcttcctgtcttaagtgcattacgtgcatggacaagcaaatgttgagaacaccctgtaatccggtaaactcaactgttgagtgagactcgatggtctctggaatcttcagcggacgacatgatgtttgaccacggccaagaacttattaacccataagccgaggccggttattgatgtaagccgacagaatgcaaatccaaaagaaaaccgctttgtataagattaatgggcaaccaaatcggtgatgcacaggaggttcatttcaagggaccgcacgtaaaaatcacctcattctcttatcaggctttcgaccagcaggtaaacataacctatccggtccatcgcacggtacccacaagaagtaggttgcatttctgttcttgtttgtggcataacccttctgtggcactcgtatatgcgtcccatgtcgatcattggagcttaagacgcgtttcaaggatagcaattcagcaaattttgaggtgtctctggtgagcaagtccaaatattatcgtattactgaagtaaacgagctcatattaccatattaacaccgtttaatcttcaaaaaggccattatttcggcgcgcacgtgacttgacgaacggcattgattggatatcgtaaagtttgaagtcacgtgtcggccgtgtggtctagtagctatgattctcgctttgggtgtgagaggtccagggttcaaatccctgctcggcccgtttttttggcgaatattttatcattttcccgtgtatttttctccccccgacaagatagcgaggtacaaggttgaggttgacatcatacgatagtgcagctagtgagacatttagccgggacgagttcttgttgtcacgtgacgtgtggtgaacgtgattgtttctcttgcaacccgagggcattagtttgtcctggcacatgtctgttatcatgacttccttgtgtattcaccaccaactgatacacgtgtcgtggcctaaagttgtgccaaaagatgttaaactttggggcatgttaattttcacggccatatgcaccccggattgttggggagaggggacaagaggatgtgagtgaggggtgggggggggtggtcccgaatgccatgcctttagtatggtggggactaagttactccaaatggacctttcagcaaaagagtcgtttagtagcggaataataacatggtgggattttcgattatctcttcaatcaccccctcaattgcatcccctcaatcttgtctctgttcctccccatcccatcccttggtgctggaagagccaataaactcatggctcaaaagggtaagatctgcactcaacattggaagagactatggatatagagcgagtatatatatagacaatttgactggtcgcgacgagacccaagtaactacttcctaaccacaggatacatctgcatatcagtacgaacggtcttccgtgactatttcttcgtgttttatcgccaccgccacacacgcctcgcaatattcaccacagtacaaacacagactcacgcaaacacaccaccaactctaaacccctgcaattagtgtgatttaaaacaccctcagtgccccactctgtcgacacactccaacaacatgtcggtcaacattctacaagacggtcctcttcccggagagccgcccaagggtctcgctgaggaatcccacacctccacagacaacctgtggagcgaatttaacaacttccgagcagatcccgtgttcttcttccgcgatctaggccgacatgctcgaagtaaggaatggcgagcctacgacgactacattggccagcctctgttctatgaaggtcacgtggaggagatcgccgacgccacgctcaacaacaaggctgtgactaaccgaatcgaacagctggctgacttgcgagtggccaaggaagcagaggaccgcaacatgagcgagtcggacaagaaggcccgaaaggccgagctcgagaagcagctgcagaccgtggcccgacagaactttgaggccatgacctgccggttcgagcacaagtcggttgtcaagacggtctactacctgaccaagcagattttcggccgaacctaccaccagggtctccacgtcaacctgcaggagattgagatgctcaaggccaggcagcgggttctgcaggagaagaaggagtccattttcttcatgccctgccacaagtcccatctggactacattgctctgcaggctctgtgtttccgagtcggaatctccatgccaattattgtcgctggagacaatcttaactttaccggcgtgggtcccattctgcgaaacctcggcgcctttttcatccgacggtccttcaacgacgacaagctgtatggctctgtcatccaagcttatatcaccaccctgctccagaagggttacaacatggagtgcttcatcgagggtacccgaagtcgaaccggaaagcttctgcctcccaagtttggtatcatcaaatatgtgcttgacgccattctgtcgggagcagtctccgatacttggatctgtcctgtttctacccagtacgataaggtggtcgagactgagtcttacgttcgagagctgcttggaaaggagaaggagaaggagaatctgtttgcgttcctttccgcgggctccattgtcaacctcaagcttggacgaatcgatgtccgatttgctgagccctggtctgtcaaggagtttgcctttgatatgatcaacaaggagtgtgttcgagtgggtgtccaggcctccaccgtggacgcaaagaacctgcctgctcccatccaccagcgaatcctccgatccgttggatacaaggttcttaacgatatcaacaaggtggccatcattatgcccacttctctgattggtaccgtgctgctaaccctcaagggatctggtatctctcgaggcgacctgattcgacgtgtcgattggctcatcaagaccatcaagctccagggaggccgagttggttcgttcggagccaagactgaagacattgtcgataacggcctgaccgtgctgggcccccagcttgtgtctgtcgagtccaagggtctcattgagcccatttactccgccaaggataccttccagctgtcttactacagaaaccaggtcattcatctgtttgtttctgatgctattgtcgctgtggctctgcattcgctcatcaagcgataccagaacggtaaggttctgccccgtgtcaacatctccgatctcattgttcaagtgcagttcctgtcaaagctgttctctggagagttcgtctatggcattgatggtattcagaccaacctggaacacaccctggcttctctgcagcagatgggtgtcatcgagtgctcccccgacctcaatgttgagcagggagtcggtcatatcaccatcaccctcgaggagattgaccgagaccgacagactctggagttcttcggtttccttctctggccttttgctgatggttactggctggctgctctggccatgtttgccctggtgcccaccgaggccgactacgaggagcgggccaagtacctgctcaccgttcctgactcggctcgaattacagccactaaggaccctctgactctgtgggtgcaagaaaaggagcttattaaccaggcccaggtgcttggtaagtctctgtaccaccagggccagattaactactatgagtctgtcaataaggagatgctgaaggatgctctgacccagtttgttgctgagggtatcttgcttgctcggcgatcgtcttctggtcgatcgcctctcctggtggccattaatcccgactggctgccctctcgagctgttcgaaagctcgacgcctttaacagactgaacactggtctggacacctccaccaatgtggtccagattggagagatcactcccgctggtaagctgtatgacttcttggaggccatttcgtacggtcgacgaaaggtgtcccagcgaaacattaccgatatgcgagttattcgaatggctgacgatcttgcccagaagtttaccactcgacagctcatgtctatcgacgaggcctcgcggccattggacgatgctcttgtcaaggtctctggcggtaagggcaaaaagcgaggcggtaagaagaattccaagatttaggaggtactataattgtttatttatgtttgatatgaccctgtgagttgtagttgcctttctgttattcctgccgtatgagtttataagttgcacgtggtttgtgttgtctcacaccatgctgctcgctgtcactctcacgtcaaggcttggtctcgcttctggggtgcagcacaagcaatgttattattctgcgatcgttgatatgtgtaacactcgctctggagagttagtcatccgacagggtaactctaatctcccaacaccttattaactctgcgtaactgtaactcttcttgccacgtcgatcttactcaattttcctgctcatcatctgctggattgttgtctatcgtctggctctaatacatttattgtttattgcccaaacaactttcattgcacgtaagtgaattgttttataacagcgttcgccaattgctgcgccatcgtcgtccggctgtcctaccgttaggggtagtgtgtctcacactaccgaggttactagagttgggaaagcgatactgcctcggacacaccacctgggtcttacgactgcagagagaatcggcgttacctctctcacaaagcccttcagtaccgccgcctgtcgggaaccgcgttcaggtggaacaggaccacctcccttgcacttcttggtatatcagtataggctgatgtattcatagtggggtttttcataataaatttactaacggcaggcaacattcactcggcttaaacgcaaaacggaccgtcttgatatcttctgacgcattgaccaccgagaaatagtgttagttaccgggtgagttattgttcttctacacaggcgacgcccatcgtctagagttgatgtactaactcagatttcactacctaccctatccctggtacgcacaaagcactttattttctcacatctggtggacgacacctcgtttttgtttcgagtgatagcctgccagatttattgtgcctttactgtcgtaccagcgtattttacttccctttccgttctttcgttttcaccatgtcgaaagtaacaaaagacgagttccaggctctcaccgcgaagatggacgccttgacgctctcccaccaggagatcaccactactctcgctaccgcggttaataccaaggaattccgctcagccttagacgagctcaagcagtcaaatgagtctttcaagacacatcaggctggggagtttgaaaagttgcaccagttggtgtcggcccagcacgaaaccatcgcgaacctcagcaagcgtgtcgactcacccccgagcaccagctcccttgaaggcatttcccgtattggcaaggctgattccgaatttgaacccgacaccccccagaagggtaactctgtcctacatggcatggactttgctgccagtgacacgggttctgttgactatcgaaaagaatccgacgccctcaagtccatcatccggaacgaggtttacccctccttgtccagcgaagaattccgaaaacagttgtacgcttacaaatcttttgattcccgggtggctacctttatcctactccaggatgacatccgttggagcaccagagctcgggctttccacctttggtgcggtgtcaacgataagcagcccctcttcgatcaacagtacctccaactccgaagcacctttgaagcagagactgctgatgaatcaaccaagccaggtgcccacgctcgtctgaacaccgcttgcgaacgtctcctccgggacctttttcgaaagcgcgggtttgaccacgaacctgctgtctcctttgctgaacaagaggaggaactccgtttccggttcaaagattaccacaccgctttctctatcgagacactacgtgcgtacctctctgctctgagcaccgctctgacctcctcacctctgccggttctctctcggtgtctccagttgcagaagctcgctccgactcacctgggcaccgccctcggacgcgagatccctcgtgacaacactcgttggctgagccttggcatggactccgaccctgagcgtgaccatcaagttgccacggagctcatccagcccctcgccaagatgatcacccaacatgtccaacgacttgacgatctcaatgatgaggctcttctgagatggcgacagcacacggtatctttcgaagacgtgtggatgtgggtcgagccttccgccccacctgagccttccacgcctgaacctgacaaagtcgtcgttcacgttgcgggacgtggtcgttccaccaggaagcctgccgacggccctgtctcaactgagactgtgcagaaacccacaatccgtgcctcggatgcctcaacctcctgggcagctgacaaggctccttgtgttttctgtggttccactgcccatgcactggtcaactgcgatgactccgaaggcagccccttggtcaaggccaagtaccttggcagcttcaagtctttcacccgacttggctaccagggttttgaaaagtatctatcgcctgttgatgctgacttccctctaaaacagagcgctctctacacttcctggaagcagaaggaatggtcgaatccgcttatggagcctagacttcgaactttcaatgcgcagtggcgtcctgccctagctggccgcgtaaatgccgttgaatttgtacacgttgaagacccaggcgggcctttggataacagctatgactctgactcatctgcgtctggttatgacttccaggaccttctccaacccggcacgttcagtgtctgtctaggaggggtgcctcgagatcttctgtctgatacgttttcctcctacgacgagcctcgcactatcattgactccactgactcccagcttgagctcacgaaagaggcaatccaccagcacattctccagatggcaaaacagcccacacccctccccgtcacttacgcaattgatgcgcctgtgtcaggctcctacagtggcaacatgaagcgccttgtggcacacccagccttcatgcagctcgtagctcgcttaactgctcccccgggcacgttcaaagcctccacgcttgaagcgggttttgtaggtgctgttatggccccgtcttccccagttgccggccgtgtctactttgttgatgcggtccagcgattgctcaacaagtacaacgtagtattgcctacgaagctttacgagtgtttcgctacagtccgaaatgacctcatggagcccgcttacgccaccgaaggcgatcctcgccgacagtctctcaagaccaacatcaacgccttgaaaactgttgtcgacagcaagcaccctgacagaccagtggctccgttgccgcgacgcagcccccgtcgtgatgtccgtgaagacatgcccccgcctgctttgcctcaagcgacaaaacgtggtgccgcttcttctacggtatcttccgctgctccccccactgctaagcgaaccaaggctgtagccaatccctcctcagtggggccgactgactccgcatcctccacgggcgctgttgttgacgtccccagctctcgtgtggctgttcaccccccccgtctgggtgataaccactacgtgagccctggaacccgtgtcaccaaccacatccacgatgcctctgccgttgcggagaatgcacccttaaaagattacaaggatgctctggaccgcctcccgtctgacctagaggactccaaggctctcttcaccagagatcatcctcgttacgacaatgccttgctgaaggctgggcgtctccctctcttcaagcttgaggccattcatgctctgccggaatcggaaaaagcagacttgtttgagcgcatcctcaaggcgtcggatgttgatggcctcgttctttttgagcttctccaggtgtgccctgacctcacaaagtacatttggaagaacttccgtcaccagcggcaccggcttgcgggtcctgacatccaagccatcgctcttgagctcggggacgatctcatggagtgtgccatggatcttgcgctcaacgtgatttcgtccacaccgtatgagctcaactctggcaccttcggtcgtcttcaggaggttttcaccaccattgaccgtcagctgtacgacgacaaagttggtaggccactctcgccccacttcaccgacaacattgctcttttcgaccaacagaccagcgccctttttgacagtggctcgtctaacaacgtcatcgacactgatttctttgcccttgtactcgcgaaggctggtgtcacccctgaccgggtgattgttttttctgacggacagtcccacgccacagtcgcaaacggagccaaggtaaaagttgatttctgggcgcttctccctgtcactttcctgggtgtcgttactcttgaaacattttgtgtcatgaagtgcagcatgaagtgtattctcggcaccggatacatcagcaaactgcgcatttcgttcgaccatgatcgttaccgtgtcgcttcagtggagaaccctggtaaccctggcgtccggtgctaccctagtgacagaccttcagctggccttgttgctcaccttgggttgcttgaccgtcttgtgaggcccggccgccggcctgtgcctgcgtttcctgctgccaagctgtctcgccaaaacgtcatggcacacgttcgacccactccctcactctgtggtgatgttgatgaagcaacaaatctccttgacgcctcatctctcggagggcctcagcctggatcttactcccaccgttctgaaacagcggcaggctgttttgccatatcctttgctgatgactgtgagtctgccggcccgccttcgagcgctgccaccgccattctcaaggctctagcgtccagctccggccctgatccccttggcattccccctcgtgatgaccctgacgagtcttactcctcatcacctgggcaccacggtgatgtctctggcgagcccaactcctcatcacctgggcacacctccgctcccgtcgacggtacgcttggacctttactgcctaccgatgcctcatctgtggatgactccaacgagctctgctcctcctcttcaggctcggaagccccgtcggaagccccgtccggagtctcggccgccttgtcagatgtaggcaccgttttccaggagagctacacgtcgtaccgtttccatgacaaccttgcagacaatgctcttcatgccagaccccccgacgctcatgctctcagtggttttatttcttctgccgacctcgacagtgttttccagtatccacctcctgcatcgccctgcagctgctgccagcagcctgtacgtgagtgtcgtgtacttggtaacactgttttcatcatggctgacattggcgactcggctaccatcgttcaggttcaaccggatactgacctgtccatgcgccaacagctctaccttgctgaagttctcagtgatgcccaagaaatcacccctgaagactctctgcattctttatctgtctccgtcaatgccatgtacaagccgctacacaagcgttctctgcctctaaataagcttcgcccggacggttcctttcctgtcggtgacggctccaagccttctccgcgacatcgcaacttctctggcgacgagtcttgccaatttgatgccaaacttgctccagtccttttcccggccgagcttgctctctgtcgccatcgcatgtcggacacggagggtgtctgggctttcaacgaagaccaggagggtgtcctcagtcaccatattgaggagcccaccaagatctacgtggaagagggaggcgttatcaactcaaagcacttccctctccgcggggctatggtcggcgctgccaaagacatcatcatgaagggtctcgccaacggccagatggagcccagctcctccccccaccgcaacgcctggttcctcgtgagcaaaaagagctcgggataccgtttcatccttgactgccagggcctcaacaagatcaccttgagagatgctttccacccacccaacgcggacctcctggctgagagtttctgtggtcgtgctgtaacttccctgcttgacattaagaatggttacggtcagaaggagattgctcccgagtcccgtgacttgacggcttttaacacagattttggctcctatcggttaacgcgcctgcctcaaggttggtgcaactctccagcggtgttccaccgtgccatgctgcgcgtacttgggcccctctttccggatcaggctgttgttttcttggacgatattggcgttctcgggcctaagactgactatggcggagccatgcatgacgactttccgggctgccgccggtacatcgtcgaacacatggacaacctcatggctgtgcttcagaatctctatgaagcgggtctgactgtgtctttcgacaaggccgagcttttcgtcagtgaggctgagttcctcggtttcctcactacctctgaaggccgcttcccgtcccctggcagttccgagaagatcgaatctttcgagttccccactactgtccgtggtgtgcgctcttttctcggtgctgtggtgtattttcgcatgtggatccctcatttcagcagtatcgctgcacctctgtacgactgcatctccgctgcgcagaaggctggcaaactcaagatcaccaagaccgaggccaccgagtctgcttttatggcgctaaaaaaggctatggtgagccctgcggttctgcaccgctacgaccccaccttacctattgtcatcaccactgatgcgtcctccctcggatggggcgcagtaatgtctcacatcgtcagtgttggccctccggctgcccgtcgccccgtccgtttcgagagtggtttgtggaaccccactgagcgtacctacgcatccaccaagactgagtgccttgctgtaaaacgtgccttggagaagtgccgtcactatgtcactggcgttcatttcgtgatcgaaactgacaaccaggccctggttttcctactgcagcaatcccgagttgaactccctaacgctatgttcacccggtggtttgcttacatcaaacagtttgattacgaggttcgatttgttaaaggccgagacaatccagtggccgattggctgagtcgtgagaaattttctgacttccgacctgtcgattttcgccctcctgttgctgatacagctcgacaagctgatgagcttgctccgcttgtgcccccgacttggtcccctgtggcctccatcactgtcctgtccattggtccagagcccgttttcatccacaaaggcatctctctcgatctcattttcaccaccattgcctccggcgatcttgatcgagatggtgttgacattccgcctagactgcgtcaaatctgctctgagttcttcatttttgacgacattctcctactgatcagctcacctggtctccatcgacgtgttctcttcacagagaaggaggtgtctgaggttctccgagctacccatgaacaatatggccaccgcggtgctgctgccatccttcatgctctccgtcgcctctattactggccgggcatggctgatcacgtgaagtcccatcgtgcatcatgcggcacgtgtgcaaaagccaccaaccatggtcttctcaaggcgagtctccacttcgtggttccccgtctcatttgggagacagtccagctggacatcctctaccttcccgctgttcatggtcccaccaaggagtaccccgatctggctgatcccgccaaggctctcgctgctcaaaccaccctcaccgacttcctccccactgcccctcagttcactgatgtttcctctgccccccgcggacggctaaatgtcactattgccccctaccagtatgtccttgtcgctcgtgatgaattctctggctggcctgaggcggtgcccttacgaagtatcaactctctctccacagccgctttcttctacgatttcatcattgctcgttttggcgttccccgtcgggtctacactgacggtggtagtgagttcaagggtgattttaagcatctctgcgaagatttccacatcaagcaggttttcaccactcctgctcatggtcaatcgactggcattgtggaacgcggtcaccaaaacctcctccactgcctgcgcaaatacggtcgtcagtggatcttatacctccacaccgccctctgggctgaccggtgcacccgtcgttcatccacgggtaagtcaccttttgagctgatgtatggtgtctctggtgtcttgcctgtcgaaagtcgtttcctgacctggaattacctcagtggcaagaccgacctggcccacaacgaccccgctcatgctgcttttctgcgcaccttgcaacttgctgcttctactttcgaagttggctctgctcgtgaccacctgaccctgcaacgccagcgtcaaaaggcgttctacgacaaacatcacaacacagctgatacagatcccttggccgtaaatgatttcgtttttgttcacgacctccgtccccacaacaagctgactcctcgttggactggtccctccatcgtgaccgcgtgtcaccctgagaccagcacgtacactgtcaacgatgttgacggtgagaacccgcggcgtatccaccgcaaccgcctcaaggttttccaccccgcttccatcgttgagttccaggaccgcatgaaggaacatcagtcccgcgagtctgctctccctgccattcctggccgcttttctgcctgttctccacatgttcttcccccggcttcagtggctactcgttccgtccgttctgcagctaccactgcgtcgactagagttacttctcggtcgaagctcgctcgtgttgattctgggcttgctcagggctccttccttgctcagggcctttattcttgattcttctaaccagggcttcgggacgaaaccccgttagacctgggcaggtgtaacactcgctctggagagttagtcatccgacagggtaactctaatctcccaacaccttattaactctgcgtaactgtaactcttcttgccacgtcgatcttactcaattttcctgctcatcatctgctggattgttgtctatcgtctggctctaatacatttattgtttattgcccaaacaactttcattgcacgtaagtgaattgttttataacagcgttcgccaattgctgcgccatcgtcgtccggctgtcctaccgttaggggtagtgtgtctcacactaccgaggttactagagttgggaaagcgatactgcctcggacacaccacctgggtcttacgactgcagagagaatcggcgttacctctctcacaaagcccttcagtaccgccgcctgtcgggaaccgcgttcaggtggaacaggaccacctcccttgcacttcttggtatatcagtataggctgatgtattcatagtggggtttttcataataaatttactaacggcaggcaacattcactcggcttaaacgcaaaacggaccgtcttgatatcttctgacgcattgaccaccgagaaatagtgttagttaccgggtgagttattgttcttctacacaggcgacgcccatcgtctagagttgatgtactaactcagatttcactacctaccctatccctggtacgcacaaagcactttattttctcacatatggttccttactgtacagtacatactcatgtatgatttcccataatcgcggactctgttctcttgtcttcttgatgagtggtgctgtgacggttgatgacgatggcgaggtgtataaccaagagacaagaagtctaccataacatatcgcgaaacggtctctttgaaaatcatcacctcctgatttaatctctcgaagagcccaaaaaatcggtgcttaattgcgaacgaggacggagacacaagtacatacgaaaagctaacaaaaccagcacgtaatgaatgatgggcccaactcaagaattctctgaccgatattatctctttctccacattctgttctcaaatttggactttcccctttcatttataacgttccgatattcttatctggagttgggcccatcactcatttcggactggttcgggttgagtgtatgatgatcgtgcttgctatttccctccctagtcagcctctaaaccggaaaaatactggtagtcgtctcaagctgagtcatccaggtttgctgacaaacgaagatgctgatcggtgtgacatgaagtaatataatgtgcactgtactccatgtaacgcgtagtctgggtgatgtgtagttatgggtctgtgtgatggttgttcttgtcgcgacgactgcctataagacttgttcaagtgcctgggttgccattgttggtcagatatacggatagtaggagagtctgaaagaactggtagacgtgtagccgtgatggacgtgatagtgtgatctggacatgtccagaaatgttatggacgtaaaagcaccataaagtaagatataattacattactgtactcgtattgtacatactgtacttgtacccgtagactcctgcagcattctagtccgcaactcaaacatatcaagcaggaagcatgaattttgaggtgtattcagaacaggagaaatttggcagaggatgaaatgactgcccccttgatatttcttactgatcataccctgatagagccggatcgtcgaagaacgtgaaatttgagtctcccgagtacagtacatacaactcgcgtacatcgtatacagattgcttccacaatcgataaaggtttcttgggctgcacgataagacaatcagccacgataagaaaatttagccgctagaataaaatagctacaaatatcacaaatatgacttgctacgatacgtggttcatgtttgcaactccagccacaataaggacctgtcaaaagcgggtattatactgttgtgtgtaaggcaggtgcagtatggagagagttggagtgaattggacagtatggtcggtgaaagaagataaatggtatgggagtaacatattgtagagctttgtaatagtatctgaacatgtgtgagttggttgaagctcttgcaaccctgaaacattcttttgaagttatgaatgatgaatgtattatgcagacaaatacattatgggaaagagatatattaaaacggaatggaaaggtattaaacatttagtaaaagggacattgaacccatttgttgtcaataattgatgaagtcttctcactcaacactactctcacgtgacactacgtttccaattcactctactcgaagaaggggtcagtgtgaggatgtgtcatactcaacctcactcatgggatatttatagacacacttggaaatttctcataatcgatttggagtgcaaaatcaactgcaataaaaattataaacccaggcacaactttctccttgacattacctcgttattgcagctgagggatgacttgtactccttttcctcccactctttccaatttcctacagctacactttccgtacttctcgaaatgccctgaaacatagctggtatataacatgcgtagtaaccgctacaatacaacaatgattattctacttctttttctctctgtcgcattaagtagtccaattatgttggaccggtttggcgatagtatgaacagcatgatacgaggcaacaatgaggcgtatgagagcggcgagacatgtggggtgtcccaggagtttgaacagcggctcgtgcggtacatgtggttcaacaatgtggctccatgtgtccccgagaagctccaacatccattcaagtgcatagccagaggctgcaaggagctggggaaacatacagagttggtcgacatttttactcattcagacaacttgtttgatcgcacaatttcaggatttgtggcgttggatcacaagcacaaggagattattctggcgttgagaggcactcaggatgtcaacgactgggtgacagacctgcatctgaggctagtggagctccatcctgagcatctgggagtatcaaacttcaactgtcgcaactgccagattgacctgggctttctcaagggatatttgcattcgttccctgctgttgacagtattgttcagcgtctgactgaaaagtaccccaactaccaactggtgattacgggccattcacttggaggcactgcagctacgctatttggacttaactaccgactcaatggctattctcctctagttttttcgactggagctccggcactgggaaacaagcagtttgccaactttgccgaccgagtcttctggggatctcagaaccccaacacgctcaaggtcaaggagagagatatcaagttctgtcgcatgacccatctaggtgactttgtgcctcggtttcccttctggaacgggtaccaacaaatgtctggagaggtgtttatcaacgacgtgcgaggtatctatccacccagggagacactccagcgatgcaacgggcaacaaaacagacagtgctcgttcggagaccagtaccgcaagctggaaatgaacttcaagccccactcggcgtacttggtgcctggaagcaagtgttcgctcagtggtgggagagagttgacattcggagaagttcattcagcagcgaatgacacaaacaaggactcagacacagacattgaaccagacattgaaccaatcttgatacctgtcgtgcaaatagactaacggggacataccatccacataattaatacaattgacgtgtacgctcaaatctgaaattttgatttcacgaacttcatctggatatcatatttgtaagtgagtacacagaaaacactgacaaaacaagacaacacgagtgaaatgacgcgaaaaacaaacgacacaactaacaaagtgcccccccccccccccccaaagctgccaaggccaagaacgacaacatgttgatcggtatcaccgtcaacaaggaggacgacttctccggatggtaccagcagattgctcgtacatacagtagcaattttgaacgctcacaatctgaacacaaacagaaacctgaatacgactgcagttgaacgtagatgattctgcgtatcagtctaatggaagatgggtatttggaaaacttctatctcgatcgtgccttcagagacgagtatctacacacctcgagtaagattaccggaatatttagtgatgatcaaattaaaccctaccaaatgttcactttgaagtattagaagagagagagggagggaggccctactacttgtatgggcagtacgaagttctgttgctacgtaatacaattgctccattatggatcagaagagatagatttatgactgcgggtactgtacagtagttttacttgtcacaaaaaggagtaattaaccaagtctacccgttgggtctgctattgtgcctggtgaaaaaatgttctcccatattctaaaataacaaagggcaatttagagttccatttgccactcgatacgacgaaccttatttaacaagcgagccaaccttcgatagctcgaaagaatcacattgagaaaaatgctggtatacatctaccacttggatcatctaatatatattccttcaattattgtgtgctaatctcaatttctaaccccatgatgagacgtttctcgaatcttctacagcgctctctttctttcgtttatgcaatgatcgacactaatatttgccactaacgcacctctgacaccacgagttgaaacccaattcggcctcctcatcaatataaaaggcccttagccggccctgtttttctactgatcagaagtcgatcagtctctcagcctttgcagaagatttgaccacttcgagagatgatgacactgctgagcgaaagtaaggaagcagtattgtcttgcgcgagcagacattcacagttcactcctaccatgacgcaacttgagttctccttatgttgccgagttggagagtcagcacacctctcttcatgcatctatgggatggagctatgacgagcaaagattcgcaatctactcaggagttccttctctcagatggttcgcaaccacgggtgaaattcccagcatgagcaacactttgaggtctgctctactggtcctgtcgcaaggcagtattccagaagttgctgagcggaagctgcaaagcttctgctacgacgtaactgttgagactgattaaaaccatgcgtgaagaacgcatgagcgagtaactaagacgtgaagctgagcgtaagctacgaagctgccgagtgaaaggaaacccctcagtacatgcactaagaggacgcagggtgatgacgagttgaaggcttagcaagccgctcatgaatcctgtctccgtggatatgaagctgtgacggacacgttaaacattgtgtgtccaagagctctccgaaggtatgggtagctcccttgggtgcaactccctgcatggataataactcctgaatgctttggagggatggactgtcgtttgaacagtcatatgtctcctccatctgctgttgacttggtatcagcacaccaggaatcacggtaaagagaaccgctgacacacgatccgaacctgatccagctttttccgcctgagcataagcgtctgcaaagaccgccaccgagcaaagtgtttgtgcccaacctgccaggccgccagagcaaagagccagaactagagccgccgaccgacaaatgccaataaaacaacaccacgataacgcggaagagcctcctggagctgttgatggtgaaactccaccagcccccagagcaggagacgttggaagcgactgagacacgttaagttatgccagcacaagagtgacactgtgaaacgatgacgacagcgcgaaggtgaaactgtgaactgcgagagcagaatgccagcaccttgagagcatgggccagagcccatcagtaagagccagagccatgacaattagccaatgagtgccaatgagccaataagagctaggtgttatgcaataagagcagagagatccagagccaacgagccagatctaaagagtcagagctccgcagaggagccatactaaaggcagtcggaagttgatctttttgatccaagattcgcattcagaaaggatgtaggcagtcgaacctcgacacgaggatgtagacgagaccgaaccttttagtctatagaaaagaggatgtaagcagtgagctgaacctctggggttaatatattatggaccatgaagtcccacccaaatcatcacctgtagtgtttctgtaaaagtagttgtgctgaattgtagataagtgtcatggaatgcaagtagcttcacttctttaaaggtatatgaaagagtatataaacttttcaatatcaacaatgaaaatttcccgattgggtaatatattacccatctaaagggaaaaagcttggaaaatcctacttttatactccataaattcttatattgctatataattccctaatatatatactgtacgacaattttcaaagtaccaagcaacccccactgctggtacttcgaaaatagtcgaagtttatgactagtggctgccgacaccaacagcccccactgttgatgtttcgacgctagtcatgggtttgttctcatcagggcagccagtcccccgttgtgcttgacgcgcaaataaaaaaagtagtggaaaatccactgagcccacaccgcaataatccgacaccccactacacaactgacattgtgttttgtacactgaaaacgagccgtcaccgcaaaagagccaacaccgcaaatagagccaacaccgcaaaaaatagccaacacccgaaagaaaaaaaaagagcactggggggcacccgagacttacttgcatcactggaaagaagcgtcagaccttgaccacgtgagactggggggcgtggtcgaagggtaagaaaagtggcatctctgcgagattccggtttccggaggtctggcagaatccaccgcctcgagcaatcttctgtaaaggaaattgagacactagagggatggggacaccccttcccaatcgagtctcacgacgtttcttcctattcaaaactgccagaagaagctgagacgaccctgatccgtggtagactccaaggaacggaaacgaggctgctctataaggccttgggaggaactttccaccaccccaacgctgcatcacctcctttccggccctggctctgtaacctccttacagagtgggtcctccaccggcactatgtgccaaatggaggggaaccaaagctacctcccgctgtgttagtatcgctctagagttttcaaggcttgcgtggaattagcacatgtctctttgactgctcacttgaagtgacacggacacaaagagctatagatcgttaaaactcacccaaaagccaacctgaaatgaatgaagaggactgagtcgatgtccgttgatctagtcgtagaagatgtgtcataataatgtcgtagaagtgtcgtgaatgatgtagtagatgaagtcacagagtgaggagaaatgaggaagaagattagaaggccacaaacatcttcagaataaggtaaggtgtagatgttacacagtggtataatgttgtggcttctcaccttaattgtatgttttgttagtcgttttaccgtaataggaaaaaaatataaaatatacacgatgtatattcgcaggatataatcccttatcctatatatatttttaattgtattgaatagatgtcacagtcacaactatcaatatattaaggttgagataatgcaatggagtgcatatagtcgaaactttgtgaattgggcgggcgatgagctattgatgattgaattagattcctcatgattggacaataatatttgctgtatctaaaatggcattattgagagcttagtcaaataaattatcaaattgcagtaatttttgagggattgagggaattgttctctttaaatacgcgacctggtctgcaggagcatgtggtcagaattttagatgtagacttatcattgcgaaaactaaaaatcaaagaaacaatgtgatgcttgtacttgtacttctaccaaagctcatagtatccagtacttgtattagttttcttcaacaggtacacaaaaaacatctgcaggtcagatcagttccttacacggatatcaatcaactttcttaggtactgtactgtatttgaaatccacctcgtaatgactaagaagtgctccccgcccccagaaaggtcgactgagatggtacatgatgagatcgaagttcgacgccatccagagggctttattctgctgcaggaggtcccagatattggccatatcagagttttcttcccggcactgatcgatgtatgtttgaattggcaccaactacagatatacgagttgtcgtaataagactatcggtggtttcgaggtctctctgtctggaaaaaactattcaggctggttatagggtctgggagaaaatactgttgtatcttgtttcccagtatcggacaggagaaaaaggtgtgggatggcgttaggatctggtagtatctgagtttacccattatatgatgccaacaccagctctctttgccgttgttccataaatggccctacctatttccatcccgcaggtatgactcaagtcaataagcctttcgaagagttcaatacgtcttagatgtggatcgtagatgatttacattaggtctaaaacacagctgctcctcattgtggacatttcgacatctgatacttggaaaacaagatacagtagcatttacacaatacaaagcaacgatttgggttattaaacatacagctcttgtgcttcaagacaatcaatacattaattatatatcccacccacacaaccccaacatccccttagaatgcattatccagcattccctccgccgcctctggaagatgtgattgagaagactacaacccgaagactcgagcacattctccctcgcaaacagaggtgattgagaacgagggttccagtgcttttcccctcacacacggatgtgattgagaaggacacgcaacccgaaggttcaagtgctttctcccccacacacggatgtgattagaaggccaaacaacccgaaggtccaggatttctccgtcacacactccaagcatccacaatccacggccgatggccccccaccacccctcatcttccactgctcatcaccttccaccgcccctcatctgccatccaccacccccttccaactcccctcatctaccatccaccacccaccacccctcactctccccacacctcctgtctttcaaacaagcccccaaatccactccgaccttccaccaccaacagcaccatctcctatgctccaacatcaccagtgccaaaattatcatcgataaaaagtaaaaaagtaaatctcacgagccggttccgccgagaacgtgagtgacgctagtctggtttcgtctctatgcaatcagactcccctcttgggacgcgaagggtgattgcaagttggtttgaaactgactgggttgtagcgtcgtgtctaaagacgaaaatcgtcagtagacacgggttttccggggcactccctatgagactctgtccctgagttcatagcatgcttggaacctgggcatggttaacgcacaccctccctgtaaacaaagtaaattcctccctgggattgagatgcccccctggagactctggcctgactggtgcctatccgacaccctcggatgacgcagtcgtttggctcatagctcttcgggaagcacccgtctatgactagcgctacctatggtagtaactagatcgtaggacgcccatctgtgttagtaagttgaaaaaatgtgatggggaagacatggcaactgtggggactcctcttgtagctgagacacttggttggacggcgatcaaggtgctggaaacatagatacctgtagtatgttgttagcctgtgtcgttattgtgtcgtttttgtgtcgtttttgtgtcgtttttgtgtcgcgtttgtgtcacttattgtcgtgtttgtgtcacatggcttggttgtgggtatcagtcgtcgaaaagcgtggtcggtgatcgagacagtgtctgtagttgcagtgtcatcgacctatgtaatgaaatcaaggtatcccatgacgttgtgtgatgtcgtgtgttgagctgtttgtgtcataaacacccgatttgcgccacaacggtgccaaaaagtccccagtggtgccagtcgaacggaagaaagcataaatactcactcaagccgcctctttcttagccggcgacaaaaagaagccgtctttttccgtgttcgagacgaaacacgtacttgcggattcttggcgatgatggttaacatgaatagaggattctggagaatctgtaaatcggggatatatttatattacacaaacagacaattaagctatagctaacatgcgaccttaaattatggcctgatttttacgtgcggggatcgtatcaagatggattatataaaaccgcgaattcgactccattcaactccaactttgacgatatcgtttttttgggttcgaagtagtgcatactaaagttttcatctcattagtccctgcattatcaacgctaacatcagaaatatatctctggtgttgttttatgcccgatgaaataagcttcgtgaaaatgacctgattatctgttaaaagtggcctgattatcttgcaagtttatggcaccgcaagtttatggcacacattttaaggttactcaacaatttgtttatagcttaaatgtattcaacggatttcttagaaaagatcatatatgggccgtatatccactaatatccaactaactctatatataattatttcaacctgtggaacattctccccagttggtgtgtcatgtcgtttgtgaagaactgattgggaagtttaacgttcttgtgtaaattcccagtatttctcaacatattaacgacattttgttgagtaatcttaatctggggttcccctcacttgaagaatgggtatcctcaggtgagtctttggagtcacatgaccatccaatcacttgaaatacttgaatcgttctcagcaagatattcgagtattacgtacgagtatcgtacgtcgtatgtgccgtggctgttgcaaatgctctagatatgagagcagcttgacaattttaccaaatcgaagagactcggcactccctggatacaagcttcttgtgtactcgcgacgaaatttgcaacagaaattgtactacttgtacatagctttctgaacaatacaagattgacattggcagttggggcagaagactgggtggggtggcacacgagggacgctggagcgccactgtcgttgaaggttccgatcgaggtcttggatactgggaagcttgacagggagattcccttggggagaagatgatcgggtaaccaacgccggagagggcgactcaggaacctgtactggagagggtgaccgacgctcaagcgggagggctggtgtcgggaagcgaggatcaaactgttcctggtaagttgccggagtccaggtctcatgagagtcgagggaaatcttagttctgattggagtgctggtggtaactgcggcagataagcttgaatgttggaaacctcggaagtttggggtgacgacaaaaatctcatcgtcctcatcgcttgaatcgttcaccacaatgggatcgtccacctcaatggggtcaggcacgtcggtgggatgatcgacgatgaaaggatcctcagtagaatctttgttgcatgtgtccatagcgctctcaaccgaggagttgctctcgtgagggtccacatcctccgcgacatccatgatatcatcgtccatcggaacttcctcgtcatcgctgtcactaccctgttcatgagcttcatccgcaaccaacgagttcataaatggggtggcgcgagcagatgtcagccgatcatttgcatctgttggctctggctcctctggctcctcgacaccgtcaatttgcggggaccgataaccccgtgaaggatttgcaaggagaagccgatcgtagaattcctgttcgttctccttcgtttggtcaggaaactcggcttcgaaagccgctgtctcgtcatctgtcaagggaccgttcaggtaaacgcgtgagacattcggctggcgaatttcagagactcggacattgagagggacctccttaagctcgtggaaagcgtcaagaaccgaagcaaagaagtccacagcagcctggcgcctctctttccactctctgaacctctctttggccccttcagcatccagttccttttgagtgctgttctcttcgttctctagttgctcgtcgagtggaggcttgccgccctcgattagcttctccatatcaatgttctggagggcctcatcatggttcagataatctcgagcgaacttgaaccaattgggctcgagaaagggcatgaagacgtgcagcggaatcttgtgcttgccatcagcagagacgcaaaacatcacggaaaggggctgtcgaactgcttttcccttgtgcaagctcaccttcttggtaaaatcgttgggtttcaatgagatattcatctcggagctggtctggtcacagttgtacatgtccttcaagtcgtatttgtcgatgatgttccaggttacattggagaattccttgggtgcagccaagatatcaacgccatccctgttccccttggatatgaggaacctgtacccgagagtttccatcatcttctggaaccaaagctgcatcggaacccccctacttgcagactccttctgcatattgcaaacctttcgccaacgggggccaatcctctccagtagcacgtcgcacaacaaccgaagaccagagtgtttaaataagacatctctgctcgcatgcttatcaatgaacgtgctcagcgtaggttccaactcagggtacgggggtctgtctccattctggtatattgagggtttttccaagagctgcttctctcgctttttcgcagcatggtccgaaagacatcttgaaacgaaacgacggccctcttgtcctgcttctccttttcgtctttcgggtcgtctggcgggacaatgccagctgccttgctaaactccgtcactgctagattgaccttgtgggtggtaccagtgtgctggataagtttcctgtaaaacacttgccatgacgtatatacacgcgcttcttatggttcttctggacgtgcatgggcttcggttgcggcgatctgctgcttgttctggctcgtcgttttcacctttcgtcgggttcgctgctgtcgttggcctcgcgacattgccttggttggtattggtgaaaaacacgtcgctgtgatccaggctctctttgcttctgatacattctggtggttacattccagtgatctacatatgcgaggtcatgcacgtaatacgagggatcaaaacaaccgaaagttaactctaaaaggaaggaggctgagaagtggaaagaaagaagaaaaaaaaaaaaggtcctgagaaaatgtacgtggatgttaaatgtacgctgcgttggtatatttctgggctccggagtagagtggatataaggcgacatatagtagaactaaatgtagaggttaggaaatgatctcttcttcaacaccccagtctaactaacacatcaggcccggttgtcatgccagaaaactccaaaagttggtcgagctccccgggagggttaatacgagccagatccattagcatatccctatcacgttagttcgtttttttagcgtatacgacacacaggcactgtgagggacccaacatgatgttcaaggtgttcttgaaaagcaaaaagggtgctaaaacccacgcatcggactcagattcgggttttataggagagtgtatgacaatcgtgctcgcggttgcctcttattcctcctctagaggggtaagggtatgactaagcacgcaacacctcctgaggcaacttggattcttattcaacagttgcggccatatcctggtgaaaatacggcttcccgtccgatcagccatagtcaagcaccagagagcccagttagtattgtagtgggagaccatacgagaatccttggtgttgcaatttctttttcttaccgcgaagcggttggtagtatccctttttgctatctctactgtagcaacctggttcgagttttcactccaagctcgatagactgaatggccgcaccactcgatggtcaatatgcagaaaaactttgataaacagagagggtctcgaaggacggtgagatagatccaagaggggaggacttcggcgcaagaatttactatctgagatcccaccatctcctcttcgcgtgcgcaaatcgttttgtacagtactcgtacgaaaggaacattctttagacgttttctgtgaattttcaaaagttttcaatttaagcacatcgtattttttttaaactcggctaaagcatgtcaactggggtatagagaaggcatattcagtacttcaaaagtgatattggtaatgcgaaataagacatttattatgtttaaactacgtttttgtgatttctagtttttttcacgtctattatcgttagaacgcgttatcaagtccactcccgtccagtacgatacattcatggtcatgcatgtcttggactggctctaatttttcatgcgtaataaatgcacacagtttggccatcagccagttctttcaaacggcgataatcatggtaaggaatatataaatctcctctaatcccacttttttcattcagagtaagatggatttattctgagacattctggaggacaaatgtgcctggtataggctactgcggtgcggagctgctcgcagtcctgctagatgacaaccatgagggaccagagtacaatgaggactacaatgtccgtctgcgttgcgtgggactgtagtagaattccagaatctcaattgtcggttaagagagcagtgatgaacttgtcgtgtcgtgtgagcctagtgcgacagtggttgaggatttgaggagagatcgccgacttcaacacagatgcgaggagacatccacctgagccagtttgtcaataagtccaacagtgagaatagttaacaagtccttcgagttgacttccttgtttcgggctgacttcttgtttcgggctgactccttgtttcgggctgacttccttatttcgggcttggtctgctggaatgtctgagtcttctagaaactgaagagctatgcgaaatgctagagccagaaaacccatagagaagagccagagttgtttacaagagtactccaatttaagaacgaaagactgtgtcgccgaggggcaacagatgtattatctagagccggtgagtcctacagagacaatacgtgccaaacaccgtcgagagcgaataccaaagtctggtcttgaaatacagtacgtgcacaatttccagtatcggggacgagccagagtcatacaccagtgaacctctttagacagagcatgtaactgaccgaacctggtctattcatttagtttcttgtttcatttctgaagagtgggaaattccgaacctctagggtaataaattatgggcctcagagtctcacccgagtaattgtcgtataattgtgttgtatttcagttattgtagtgtctgtcattgattcggcttctcagtatgtacatactgtactactgctacgacaagagaagaatgttgattacgctaccactgaaaccattacaattgtttcttgttgattatacttgggtctttggatgggtttctatctcgaattattgccattatcgcttgtctcctcattccggacagggtcatggagtccagcgatgtgaaggcgtatgtttccatgccccagagtgtcgatatgggtattgttccactgtatagacaatatgttcagataaaagctccagggatatcgaatgatgttttgaaagcgtgtgaaggagattcggtgcgtcctaactgtctaaaaacaggcctgattaatcgattgacattgccaacgcatctcaacattgtattaagcagtctgattaacacttcaagcctatacttcaagcctatacttcaatccttctccttcaaatgtgtgctcgagacgacgtccatcgtacatacggctatgtcaacatcgcgtgcttattcttccctagagagcactaatgatgaaaatgagttcatgtagcactgcatcgtatattcatatttcaacaaccgaagacgactttgttgaagacgacgactatcacatggtaccagtagaaaaagatgtattattcctgttctacgaccttcttgcttctccttatcatacggttacagtactgtactactgtactgtacatactgtacttgtaatgtccgtgcagtattcgtactagttcagcgctcgaagaaactagacacaaaaaacagagctattaatcgagcgcgaccagaaaaaacgttcaccatggaaacagcgcaagcccaagcttcggcgggtaactccttgggcgctccgaaccccccacctcctgatttatcgcgaggtgatggagccacctcaaccgaaacccccaaccaaaccgacattgaaaaaatccaaaaaaacgacaaaaacgatgaaaacaacaaaaaaaacgacaaaaacgacaaaaacgacaaaaaaaacgacaacaatatcaccctcaacgcctggaagagcaaggccgaagtcaaggctctcctgacatcgaacccctccacactcaaattcaacctcaacaaggagcgaatttcggagccccttgcggcgccgaatggtaggcatacctccggccgtttcaacgtgtcctatgtagccagcaaggaaaacttcttccgaagagctcttgaccgctccgccacccctgattggaatcttcctatctccatgttcctcgagcacctcgataacgccgcggaagtcgacgagaaggacaccatcagtgtcctcgagggcgtcatcgaaaagttcgacgagatcaagggtcaggttggtctggcggagtttgacctgtccaggcacaacctagacatcgtcccccacctgatcgaccagactaacttagaacaggaccctgaagactgctaccaagtgggaaatggttggcactacctgacgtcggacgccctcactgacccccacgaacaacgaatggctgtcattctggagacagttagtctcattgttgaggccaatactcaagattatcgcatcatgaggaagggctcggctaaccctgctggacgaagagtactttactacttcaacctaccctcgtacatgaagatggagcgtcagacggaggatgctttcaagatccacctcaacgctattctcaaccagttcgacgtagacattgatcaggccattccaggttcctccctcttgagcggcacccttctgatgacctctgccaaccatcagaacatctcgggtcctgtgatcgcagttcgtgctctcctaggctccaccctgccccagaccatccccgacttcttcgtcaacctggatcccaccaaggctaggcttaccggctcaaagttgatcaagatgcacttcgccaacggcgataacatctgtgttaagtgcaagagcactaagcacatccgggaggcctgccccgagaaagacatggtcactcccaagatcttccgcacccgcgctcaccagggtaccctcccacagagaggtaaagcccttgcttccatccatgccccatccaccgtggagcccccggtccaaactcgcaagttccaccacacgcctgctactcaccagtgggagaccgtcggcactaagtcccctagacatagacggactcgagacacgtccccccaacccaccggtcagaagcccctccgatcttactacaactttgaagtcttgagcgacaaaaccggagaggacacacccgaagagaccgagcaaactaaccagctgccctctacgaaccagcagcatggaactcagaatctacccatcaacatccccgcctccgaggaagacacagttcccgacgaccaggaaacggaaccggctgacgtatccatgaacggctttgacacccagcctgacgcacttgctcaccctgaagtagcccctgatgtcacccagtttcttccccccgctaccccgcttaacaccgaggccaccaacaacggccttccccacgaccacaccagtcccaacacgaccaaccaaacacaacccccccccccggaagtatccacgagggccgaccccgaggagggcacaccacctccagtttctctggcgagccctcccacaccacgctcggcaagaagcacattgcggtcttccagaccgcctcgagcgaggttccggtgcaaatcctgaacccggacaggtcggagaacagactctgctggctgccttctcaggaggtagcaaagttcattgacgggaggtgcccgacattcctgtctacatgccacttcaaagttttccacgacggggcgacactcagctcggtagacgagattgtagaacccccgaacagtcccccgaacccccctagggtgaccactctccatgaggtggacacaatgctccgaccggggcagaaccagtaagcatgtctttcacctctactaccaccccttctaaagccccatgtaagagcacccaggccaaaatgaaatctccgaatgttaaagtcatcacggctaacatcggcggttttaagatggcggaagcgcttaaccgattacccgacaccattgtaaacattattcgaactactcactaccccgatctcgtccttcttcaagagacgaactgggtggactcctccctacaaaccgctcaacaaatcatttcaaactcgccctacccggggggcagacactacaccctcctcggctccacagctggtgtttctaatagaagcgtcggcgtggggctagtctattccgacaacgtcaccatcacaaactttacaacagtttttgaatacttcccagccctagacaacagactgtgtttggccgacgtgcacatcaaaggcaccgacagacacctatcgctgatcaacgtatacgcaccaaacgagcagggagcctcccccttcactaaccggcagttctaccagtcactagacgactatctacgcctccatccctgccaataccccctgatagcggcaggcgattggaacgcggtcgcctccaacgacggcaggattggcgaaaaagtgacgactcaccttaaggacttcttagctaactgggacttactagacacctacactctaatcagcaaacacagaaaaggcctttacactcacaccaacaacagccgcggagcgggcaggcgcctggatcagctgcacatctcttcgacactctcacagtggatcaaatccacacaactggtaaccaacaagcagggtcacaacatcacgaagtcctctcaccacgcggtccaattcgtctttaactttggcaacctcacccagcgacaagacagaggcccaggcacctggaggatgccctggtgggtttttgatacagagtacattgcttggctcaagttccacgtcaaatccattctgaagcgatatggtcctttgaagcccagcctgaagctgcaatgcctgaaagaaaacattaaggtcaccatccaacaggaagccaaaaaccgcgcacttcgagattccaaccacccagacaacagacgccgcgaggccctcatggcaacagcctcagactggcaagcctacccagctaacgagccatacccgatgctccatgctcgggtcgaacaatccaagcaacagatggagatccactccctacggaaccaccaaggccgagtgaagaccgacacctcctctctctgcgacatctcagctcgatactttgacaacatcttcgacagagctgccgatatcaacgacaccgacgacagcgcctttttagacctcttccccgaagaaacccggagggtgaatacagctaacccaagcctggactcgtcttttaccaaggaggagatcttcgataccatcaaggcgtctacgcacaacagcgcgccagggccagacggcatcccgtacaggttctaccgcgactgctgggatgagctgggggacttgatgacggacgtctacaacgaagctggagccgactcgcccatcagcaccgaacgcaacaccgctatcatcaaactactgtacaagtcgggagatcaggccgacatctccaactacaggcctatttctttgatcaacacagaggtgaagatctacacacagctcattaacaaagccatccagaacattcttccggacagcattcacggcgcccaaaacggtttcgtaccgggtcgacacatcactaacaatctcgacaccatggatcatttttgcaacgcctactcccagctgaacatgggttgggtcgtaggatcactggacttccggaaagcctacgacactatcagccagagttgggtgataaagacgcttcgaaatgtgggtgtctcggaactgatgatcaaccgtatcctagctgtacaacagaacgcagtaacgagaatcaacatcagaggtgtcctatctcgcccagtccgcatcaagatcggagtgagacaaggatgccctctctctccaaccctcttcatcatcgcagtagacgcacttgtgcgtcgtctggaccgagagatgtttggactggccccaggcctgccactatcccaccaccacaccacagggcacaggccgccacaaccccctactcacccggaggcagtggcagctggacacatgaaggtgtcggctttcgcggacgacatagcggtgttcctcaacaacatccaggacgtggccacggttggtagagtgctctgcctcttccaacgggtctcaggcctcacactaaacccgtcaaagacggtgcttcagaagatcggcccccccgattgttttgttccactaacctttattgacgcagaatggcagcgaacaattgacgccacctggccaaccgacaacaacacacgacaggccccgacgctccggacatctgacaacattttccggtacctcggagtacacttcggaaatcgcgaaaggttggacacgcactacgctcagatcaaggaggacctcaaggagtcgctgcgacgcctttcactatggggtctcccctattacagcaaggcgtggatgatcaacatctacttcttctcgaaactgaatttccttggaccctacgtcagccagatcgacaacaccttcatccgagagctgaacgaactagcgtgcgacaagatcaacaaattatcacccgacaaaacacgcaaaaccttcagcaatggtttcatccaaactccggtaggcagaggaggactgaacctgcgggacatgggacgtttcatggtgtgcctgaaggccgctcgggcttacaggttcttccatggctcatcgccggccctttgggactgcaccttccagttctacagcagaactcacagtctcacacaggaaaagccacaccagcgcgtcgactgccgctttccgacaggccaagcttggggctacgcagcctcccccaccatgcgagacgcaatcagagcttctttcgagctcaacaagcccctcaccgcggaacatgccaaccctcgagaagatcacgagccctctacaacagacacagttaatcacagaatctgggaacgaaaccaggtgaacgtgagagcagcagaatctttccgggaagcgcacgtcgacatcgcagccgcgagacgataccatccggtcagaatggtgtccacagcggaaatcgaccacctccggtggagcatgggaccacttactctagagaacttcatgtttcacaagacctcgtctcccgacttgccaaacttcccacacacacttgcacgaccgaagaagtggactcaacgaagcgactacgggggcatcgctgacgacatggtctggcaggaggtaatgcatgaccttcgaaaacactacatcgccgacgccaacaaagcacaagttcttcacctcatgcggatatctcgacttccgctcgtgaaatggagataccctgacgaccacgttttcaccaagaagaatccaggatgcgggctctgtgataaggccatcattcaggatctgcacgagcatatcttctgcaagtgcgaagttcttctttccatgttgaccaggatgaagattccgtcagtggactctctaaaggactggatctttaccgagtcgaaatgtggagtactcccctctttcccagggcatgtgaacagtgacgccccccggaaacatcaacaagtcaagacacgcaaatatctgcgggaattggcttatgggatctggaagatggagagatccctccggtactcaggggacgacgccaccctgggacatgtccaacagggtttgcttcaattcctgaaggaagcccagatgtgtttctacgatggacaaccgccagcacttcacgatgagcgagagtagcgacagtagcaagcgtaaaaggcggccgaggccaccgagagaacagcgtagcagggcgcgtagtcaccacaggggacgcagaaccaaaccaatgacgaagaagaaccacaaggagacgttttcaaaggcaatgcaaacgaagagggcaatggaaggattgagattagagaactggagactggagtggcgttttcccgatgaacgaacaaacacgcgaagctatgtggaccaacatacaacacggactgaaccaggtttttttatgatttttttactggaaataggtacgtgccaagttggaccatgacactaaacgtgtttaattagtaatattcgtgtaagcgtacattcatttcaaaggttattctttcaaagcaaagttataattaaatgaatgtatatgcagaaaaaaaaaaaaaaaaaaaaaaaaactatacttacatcatcatcaactgtcagcttgcaactctccaagatcttacaccctgattgtaacccctggctctgtttcccacgaatttctcacccgcaatcaactatatataatgtctcatctctttccctacatcgcgtactcctgataataagctctaacaacctcccacatgcattgccatgtgcacattgcacaccaacttaacaagccaagtcaccatcatcaccatcatccatgtcgtcattcctcgggctctttaagcggtccgacccgtcggccaattacgaaaaggagctacaggttctccagaccaaacttgcggagacagaaaaacggcttttatcgcgacgtttgcgactccgacgcaccaagggtctgttcactctttactcgctggtcgtctacattgtctacgtgggcattgtggtcgccaagaaccagttgagccgtgaccagctgctctccggcaacagactcacactgggtgtgcttttgggtcctcccgcaatctacattgtgcgatatgtgatccaggctgtcttgggtcgttttgtgtctttcgacgaagacagaatcaagtatctgcgacaacaacaagagggcaagctggaggagctcaaacagaagacaggattctactccaccaaggccattgtcgatcgatacgagcccaagaagaaggaggtcaagaaacccgcccagcagcaagcaaacaaacagaatgcacctactaacagacgacaaggcgttcctcctcccacagcaaacgtgcctcgaaaccttccccccacagctaacgttcctgccgtgcctgtcgtgcctgcccctgggccaggacccaatgtacctgctgctgttccagccatccccaaacccgtgcctgtttcggagaaggaggttctggcagcgaagcagtcgctggacaatgccggcgtttcggtagcgccagtttctaccggtccctaccagcgccaatggtttgatcgagtgctggacctgcttgttggagaagacgagagcgccgctcagaacagacaggcactgatttgtagcaagtgccacaatcacaatggtctcgctccatttggcaagactgctgctgagatcagatacaagtgtcctaattgtggagagtggaacggaaacctggttcctaccgaggctgtcgagcttgttgaggaggtgaaggaggagaatgaaaacgagaaagaagaggctgaggaggaggagggcgatgcagtggttccttcagaggtgaaagagttggtctcggagatggtctctgaggttcctgaggtgtccatggcaaactagcatagcatgtatgagtagatgattgaatgtgtttatgattgtggtatactagtacagccagttaacatttacattgtaacatgaacgtggatgcaaatagatctagatcacctgggatcagggggtcttttggagagcaagacccagggacacactttattgagctacaatacacattgatctataccaaacacaatgtccgtcttgtacaaaaggcgttgtgaatctttagtggcccattctaccttcttgacccattgatccacttgttgctacttgtctgcgcagttcagtccctaacattatgtactacatcgtaccttcttgtaatacagtaaccaaatgcatcctccatcgtctatttactctcttgtctccctactggtccttcttcagcttcttgaccatgagataggcatccttggccggggtcaggcgcttgtagtaacccttgacctcgtcgacaatctcaaagcctcgcttcttgtaccactcaatcacctccgtgtcgtcggtcagagcatggacgctcaattccggaacaaaggtctcggccgcgtaccgctcaatgtgatccagcagcatgcctccaatgccgttttcccggtaaggtgacagcacggcgatggtcatgatgtagattcgcgacggcttggtgtgttcgggggccacctcgaggcagcatcggatcgctccaacggggatctcgttgtagtaggcaagtttggccagctggcccaccgtcagggcctcggtgtagaaggagtcggtgtacgacgtgggcaggacgaccgagttgatgcgtttgagcatgcccaagttgttgggagtgaggtcgtctagctggactttgctcattgtgggtggatcggtgattacggcggttcagtggatttctcgtctgcaatatctcctgtgacaaaaataagctttcgggatgcaccactggtgtgctccagacctgaaatatatccggcaggttagagctctgcagttcgattccagctggcgaaaggggcgaggggaaagggaaaggaaaaaaggaaaacagggaaaaaaggaaaacagggaaaaaaggacaagaaaaggagaaaagatgaaagtgttgatgaaaagagattaatggttggcaggaggtgtctcgagatgtgagatactgtatgtactgtactatatggtctgtaccacgaggtgtaatccccctctatcctgtattgtctgcataatacataactttacttgggattaataaaataaaaataaaaataaaaataaaaataaaaataaaaaacatatattgtcatttcaattatgtgtctactaagtgttatccaactacttgtacgacgtaatactcagtgtaggcctatggtattggcatggtgacatgcgcaaactcactcgaccttttctggtatgtctacgcgcactccaactccgatagagaggcaacgacagacatccctcttaacgtctataacaaatcaaaccggacatgaggagaaattttcctagcgcggccccgattgtcagcgtgcgtggaacgcctcatcagtactggcgtggctgaagagctggggatctttcgagactaaggggttcgggtttgcttatgtgacctccaatatcttgtcagctagaatggtcactggggtaatgagtacacttgtgatataaaatgatgttctaatacgtgtatttgtacggaatgacactggtgtacctgatatactgtcctgttggccgattatctgcctgcattcttgacaattgaatgtatagaagtatcatctacacttttagtagtaatgtacatactgtactgtacttgttcacctatatcaccaagcgatatctactcaactgaactccccaaagtcaaactccccaaagttgaacccgcgttcgtcgtctattgagatgtctatccatgtcaggctacatcattgtttagctcggcacaatgtttcgaacatgaacagtttcgcatgattctttatatcatcaagtgttcattgagtatactatggcatagtaaataactgcaaagaagtgttcatccagttctcatccagttctcatccagttctcatcctgttctcatacagctcatgcagctctaaacccgcgcatcaacacatcagtgctcctatagacagagacccatgtcttcacagatccacctccgacacgtgctcaccattatttggatttgatttgcattttttgcatatataagttgtgaaaactaaatccaaatgttttctttttttcttttttttcgtgagcaaatacgccgttcggagttgcatggtgtaaattacacggctttgcgacgtcaccagtctccagacaagggcgcttaatgaggcaattaaacgagttgtgcagaattatattagacaaagaaatggcttggatgtgagattcggcggttgtcctttcgcatttctcatatcgtcgtctcctacaagtgtacaagcaagtgagttataagtcatcatatcatcaattagttatttacatcattaaagcgtttttagaatcgggaaagcatagccagctatgtgaaggaaagtggggatggtgggctttctacatcttcttctcctcctccatgccctcggagatctgaggaatgttttcgggagaagtagaggcctccatatcgtgatgctgctcgtactgagcctcttcgtcatgggggtggatcttctcgtcaatggaggaagagtcaacctcggagtcagactgagtgggctcgtcggtgtcaccaaggtagacgttgggcagagtgaaggcggcgacaaaaatgaagccagcaatgatgatgggagggtagagaagctttcggtaaatgtcgttgaaggcggtgacaatggcctctcgctcgggagtgccccaagggtacagcttgatgggggccatgaggttgttgaccacctggtgggcctctcgaggggacaggaagggcgcgtgcttggccagctgcttggggtaagactgtcggtagagggtaccggcaatggcctcagccacaatggagcccacggtcatgatggactggtaaatggcggtggctgtgaccacgttatgatggggcaccacggcgtggatcatggagatcatgggggtttggaggaagccggctccaacagcctccacacactgcgagacaatgaactgagaaagacggtgggtgggctttcggtagttgtaggtcagaccgatacccagcatgtagatagcggctccggcgataatgacaggcttcattcgcttgaagtacttggcgtaggcggcagcaaagaaggacgagacggtggagccgaccacaaagacgtttacggtgttagtagctgccttgacggacaggttcttgcacaccatgagccagggcaggtagtaggttccgtacaggaagtaggccagagcgtagcagaagatgagcaagcaggtggtgaacatggttcggttggtaatcacgtaggagggcatgaacgggtacttgggtccaaagatctcccagaaggggaagatgaacagcaggatgggtccgatgatgatcatgaccagaatgtgggcctggccccaggaggtcggagaggtggccagggtgactgccaggaagagaagacagagtccagcagtgaacagaatgagaccaaccatgtcgaactggctgaaggtgcctcggaagtttcgcacggcctttccgtattccagacccatggctcgggctttgaacttgagtcgtagcagaatgatacacacaggaatggagaccacgggcatgataatgcaccacattccgtagccccatcggtaggtggagttcttgagcactccagaggcgatgggagccgatacccaggaggcccagacgtaggcaaagttgggcagggccaggaagaaggtacggtttcggaggttggaggtgtcggtagcgaaaacagcctccatgaactgaatgcccacttcgccagacacgtagaagatgtgggcggcaaagtaggtggcaatgttggagcctcccgccagcatggcaaagccaatgatgtagaagatgatggcgagcaccagagcctcgactcgacccaacacgtcggccagcttagcaatggtgggtcgagtgacggcgtaaagaacagatcgcacaactccaaccgcggacaagagacccagctcgttgaaatgggaggtagcgacagcagcataggtggaggtggtacctcgctccagagccaccactgtggagaccagcatcagggagatccaggcaaagaagagcatcttcttgtccatgaactgcttgatggtctcaatctccttggctccgtcggccttgttgttggagtggtcgtgggtcttggtggtgactacggtcacatgggggtcgaagatgtacttgatccaggtctcgtttttctcctccggggaccggtggaaggggttttcaaaggtggccttctggaagtggaagcttggtttgtggaggatcgccatggtcgtttgatctgccctctcaatacagcgtgcccggaccctctatataatgatggacctcgcctcgggtttgatctaatcaatctcatctgagacaccttgggggttgttttctgcatcgtatggtccatacggcatggtattggaaactgtagctcctcggttttgcgcttttcacctgcaatttaccttccgctgagcttggcacaatcatcgtgaagatgacagtttggcaaacccaaaactattccgaaatcatggagtacaggagccttgcagatgcaagcattttccactaggcttgagactttttttgcgcttcagatgaaaatttgggctaggtttgtgggtttttagcatctcgaatgttgagcgatttacgtcgtttgggcggttgaaaagaacatattgttggggttttttatactgttgtgtagctctggatgagacgagaaatctggtcaagtcaaactccttaccttctggccggaatatctccatatcgccagaaaaccccatagagttaaactcatgaacctagctatacagagttatctggtaaggggcacacgacttaaattaactgggcgaaaaatggacattttggaggggtttttggtaccaatggattcttctcggtctgtaaaagaaaacggtgaagtccccatccacccctgggccctgaaaaccccccaaacgacccttctcaaccttaatggaccctcttcaaccctaacgtctctttctcctgcaccgcttaattctgtcttaaattttgtcgactgtacctcgccatcatcccatgttgaacctctgtcggctcgctccgtgtaggaagtctgttttggtaagacactaaatttcttggctcggccttaagcaggttgatagagtgggatacagtttggagggcggtttgggcggtgtctgggacccaatactgtctggatccacccacaaacactttcatcttcctcgttgccgccagacgatcaatttgcatgtctcaaaccgcccgcttcgacttctacgcgtgcttctggaacggtcgcattgcatgtccctgagcctaaaccctggagcttcggtcaatatagcatctacgagtacagtacgcaagggaagggccaagacatgcgacatttttgtgtttccaggcccagaccggtcggtgggcggctggcaggggagaggcacggacgaattgcgtgcctgacaagcacatatctgtgaaacccccatgatgtcaccaacctggagcaagccaacaaccacactgctaattgcggcgatacgagggtatttgaacgtcaccaaagagcgaccggcgattagaattggtccaaattgcctagctgggcggctaaacatcaaccacaattggtacacaaccaggaacaagccgccgccgtcgcctagatgacacggtcaagagaattcactccaacctagtataaagcataaattgggttgtgctctaaaaagatgcaaaagttcaacaggaacaaaaaaagaagaaaaagaagaaagaaaaaaacagacacaagatacggttcaagctgcgggcccggggaaactggtcatagtgtaaggatgaacagtacagaccgacacaggcgcgtcatcggccagacttttgccaagccagacattagtattctgccaagtatcgctatacgattatcgtcgggaagcgacaatctgtgagctaaagtggtttccacggaccaaaagccgctatgctaacaaaaggaccatttggatatctcctccaactccatgacgctccaagcttcacgataatatcaattatagtcgaggttgagtgtgtcttagtggcagattggcaactctccccaagtgcaagtgcaagtagacttctttcaggcttgtgtcaaactctagcactagctacattagagaacccccaccatgtctctcttgtctctcctagtccgggatcgtcagacttggcgttttagcttgccatcccattgagctctttctgccatcactataactatcatttatgggaagcgggactcctataggaccaactaacaagggggatctattactcgtacctatactctatgcaagaacgtacggtttcaagccctttgctgtcattttgacttgggatagcgggtcccgaacggctccggcatgctatacacatgtgtctgagtggctttcacaggtgatccaatgttcagatgccagctcttggtcaaactaacagtatgccagccttggagagcagtagagttaggagatggacttgggggcgcgcagatgaagggctgtgtagacagaaactacaccattttgaagggctaaacgagctgaatccaatggtaccattctctcccttcaattgcatctccctcgtttcatatcgtcgacgtgtgctaaggttggcactccccgaaaaaaggcaacgcacacatggcgggggtgaatttttcggttatcgcgacccagctcggctcttgagggagagtttaaaaaagcagtttagcacacaaataagcagcttcgtaccagaacttttttatcgcaaaatgggcccttgtgtgacagcatttcagcccgtctttatgattgattttttttgacttcctgacaaggttggaaggggaggagatagcatttgggggctctggtttggcgtatggggggactttaatggtaccgtttaaatcgcctggtgcgggcgagcagaatggtacttttggttcttctgaattcctcctggaaccttttctttaggagttctgattgtgtcttggccgaaaccctgttgtcccttccaaccttggcatcattggacaagatgatcagagatgatcaaaaagatctagagtttctgtcagcttgttgaccccctgtgagtatggttgcatcacgagcttcgcggcatgttggggcgcctaatttcagatattgccaatctcggaggagttaactctgtccagcagaagatatcagggtgccagaaagttgtttccagacaagctgtgaagatacaggtgtaatgtcgctcgctccgaggagatccgagagtgtcacggatctatttgatcggggatcggtaggaattgctaggccgtaacgtagtctcaagtgtacgcctatgagtacggtatgtccaagtgggccctgtagctgtagctgttccgacacactccaagctgatacatcctacaagcctgcgtgcgcttgttgcaggtcgtatacggaagtgttcgtgagcgatgaacaagttgcttttggcggtaggctggtggaattagtggtggtagttccgccgtggacccactcgcagactagaggctgttgcctcgcatgtagagccagccgctgttagattggctccccgttatctcctagaaagccgtaacaagtgtctcgccgtgctaagacatggacattgggctcttcagagttggcatatgtcagctgaagtggcagaagtggccgaagaatcggagcaaaagccaagactcgggtcggtccacgagctgtggtgtacctacactaaagatgcggggagagaggtcttgggggttcttggctgaaaccacaacggtttcatcaactgttcgatgcagtcatgcgggtttactggttctatgggatgttattctacatggacagcacctgactggccaggcagtacacggcacagcggtctcgctacgatactatagacagcaataactctacgatgacgtcctaaaacagacaatgtaaacccaaacgtttgttcctgcaccggggagcttgagtctagaggggcagagtgtgtggtatgtacgatacagtaagtagtgtgtgcattcgccgtggtccagtaggagtactcataactggctacattgtgtaccaaaatgtatggtggaaccacttcagtcattaattggcgtgatcactgctggaatctcaactccacgtcaccaaccaaccactttcgcttcaagtacaagtgttcgtacaaacgcacaccagtttcacgcaaaccctcacggagatgtgtaatggacgaacggtgataggtcctttttcgacggggtttggcatgttttccatttcaatttccaacggccccatcacgtggacagaccctgcaacgaagctcgtgtgagcgtccatacacattgttgctgttccaccattactcaggtgtcacctccaaggtccccccctttcgagataagaataaaaatgaagtgtaaccttgtgacaatagaccactcgtaacagcgccattagcaccatggccagtgagttcgggtgggtccatcatcagaagaggcaaccgagttacaccgttaccacacgatagttcggcactttttctcgtgattgagcgtttcttctcatcctcaactgtatcagcaaagggtttccaaaagtcgccatatccgaaatccaagaccgtcatcgttctcagaagaccaagagctttcgaaaggtatcatgaatgaagaggagctttcgaatggatgtttgtttcaacaaaattccaacttttgagactggttagttagtacaagaaccggtccagtatcaacacgagtacaagtcaactaatgtgtcgaaataaaacatttcctcaccagacgaaacccatctcatcaatcacgtgataacaacccccaatcacgtgaccgtggacctcttggtggatctcttcatgactctcctcttcatgactctcctcttcatgactctcctcttcatgactctcctcttcatgactctcacggctcttctacccgtatgacaagactgtttgacttttatctcgtggattgtgccttcaaaaaatcgcctatcgcgtttctacttggtccccttatcaccatccagtgcctgtctgccgtgattcccctaacccgatcgccagagaaggttcgaggcgtgctgctgtggctagtgtggcgcagctccggtggcaaatgagaagctcgtatgttattagggtttggaaaactgtggatgctagctgtgaaccgaaggaggagttgatatagggggtatctgtagatgaaggggagaggatcaagacgttttgaaacaagcgtttgattagtcatcgggcgtctacggcgtcggggccccccccacttagtaagcggctctcgacctccccgcccactctatattgctcaattgtgcttgctgactgttcctgcaactctgtctgcaaaactctacctagaccgacctgcgaacttgtacacctcaccacacaccacacaccgtacatccaaccaagttcataatgctacttcgaagccgtttacccgcggtacgaagtgtgtttgtggcgcgcggaggcgttgcagcccagctggcctccttcacgacgtcgtcccggcttctgttaccccggcgagagtcggacaagaagcccaagggtggcaaggaccgcggtcgtcacaacaaggatcacagcaaggaccgcaacaaggacgtcaacaaggcggccgaggacttcctcaaggacgttcagagcggcgacccctggcgcaactcgcccaaggccaagtggagctacacctggggcaatctcaaggacgatcttggaggcaagtccaataaggctagccaggagaatcccaacaagaacgacaacgacaacgaaaacgacaagaacgataaagagaacaagaacaaggacaaaaaggataacgacaaaaaggacgagaaatggaaggacgaaatgcccgcgggaggacgagagatcgaaatcaaggtcacccctctgggcattgccggaaccctgggagccgtcggaatgctcatctatctgctgaccagcggtggtgagggatccatgcacgaggtctcgtggcccgagttccgatcccagttcctggacaagggcctggtcgagcgactcactgtggtcaaccgagcctatgtcaagattgatctgcgacctgagggaaacaccctgggaaacaagactctgtacctaaccattggatcccccgagagctttgaacacaagctggatgaggcccagaccgagctcggagtgcctcccaacagaagactgcctgtcaactacatcgagaccaccaactactttggcctggtgatgggtctgctgcctgtggccctgacccttggattcttctactggatgtcaaagaagattggttctgccatgagtggcggcggtctgtttggcggcgctggcaagtccaaggccaagctcttcaacaaggacaccgacgtcaaggtcaagtttgatgacgtggctggcatgggcgaagccaaggaagagatcatggagtttgtacggttcctcaagaacccccagaagtttgaacgtcttggagccaagatcccccgaggagctattctgtctggacctcccggtaccggtaagactctgattgccaaggctactgctggtgaggccggagtccccttcctgtctgtatccggatccgagtttgtggaaatgtttgttggtgttggagcttctcgagttcgagatctcttctctcaggcccgaaagatggcccccgctatcattttcgtcgatgagattgacgctattggaaagaagcgaggttccggcaagtttggcggtggcaacgacgagcgagaatcgactctgaaccagctgctggtcgaaatggacggtttctcgtcttctgatcatgtgattgttcttgccggtaccaaccgacaggatgttctggaccctgctctgcttcgacccggccgattcgaccgtcatattcagattgatcccccggacatggaaggccgaaagcagattttcgctgttcatcttgccaagctgactctgtctcctgaaattaaaaaggacatggattacgtcaagggcaagctagctacgctgactcctggctttgccggtgccgatatcgccaactgctgcaacgaggcagctctgattgccgctcgagacaactccgtcgatgtcaagtttgaccactttgagcgggctattgagcgagtcattgccggcattgagaagaagagcaaggttctcaaccccgaggagaagaagactgtggcctaccatgaggctggccatgccgtctgtggctggttctttgagcacgcagaccctcttctcaaggtgtctattgtcccccgaggcaagggtgctcttggttacgcccagtacctgcctgcggacaacaagctgacttcccgaaaccagctcaaggaccgaatggccatggctctgggtggccgagtctccgaggagctccatttcccctctgtcacttctggtgctcaggacgatttcaagaaggtgacccagatggccaaggctatggtcactcagtacggaatgagcgatattgtcggaaacgtcttcttccagccccgatctgatgagcagatcaacaagccattctctgagaagaccgccaagatgattgacgacgaggtgtcgcgaatcattgacgaggcctacacccagtgcaaggacatgctggagagcaagaagcacgagattgagttggtggcccaggagctgctgaccaaggaggtgctggcccgagaagacatgattcgtctgctgggccccagacccttcccagagaagaacgaggcgtttgacaagtacctgagtggtaccaagaagcaggagggcgaggatcatgagggcggtgagaccaagaccgcctagggactacggtagtagttgtatatagtacgcagaattgcaattgtattaacggacaatggtagcgaatcatataacccgagcaaggtgagtatggttcgtgggacaagtagacgggttggcaagacgagacgtcttttctgagttgtactagatggatagatgatgaaacacagtgcacagtggaggcaggttataatgtgacaatctacaatggctctcacaggtctatttgctactgtttcgtgtgataattacacaaaatatacaggttctataaatatattatacaagatcctaccgagctcactctaagttgatactcgaaccaatgcctccctcaacttgtgaacttcctcgatagtcgtagtcctcatggccaaccatattacccctcataattgtagtttccataatccatgaaaccactctgatacatgtcaaagtaccactcattgcccggcctcgagtacatctcaggcaagacatcaggctggccctgagggtagtcgacgggagcataactggtctgggcagctgtctgctgctgctgaggataaaagtcgttcaccatcatgttgtatgtactatcaacagaagacggcgtcgcatgttgttggggttgctgagacgcctgttgttgctgcggctgctgctgctggtgttgttgctgcggaagctgctgctgcggaagctgaggctggctggaagacacattaggaggtatgcttgtgggtgtggagtagacaagcttgtctagagcagtgttggggtccagcttttcgccagcctcctgcttcttgtgtcgctcctgagcagtgtccacaaatttgaccgccacgtcgtaaaactcggtgaagacaagcagaaagctgaactcctcgccgtcaggcagtgacttgagaaagtcaatggcaatcttcatgagctccagatcggctcgaatggtcgcttctaggggtcgctgaagcacgtggatcagcagaatcgtaaatgcgctcagcaaaaagaaggaaaacgaccagaaacaagacatgagcttgacggggatgttcctcgtcagatagattgtatttcgagcagcctggacacaaatggagtgagatgaaaacagtcgggggttgggactgcccttgttggtatcttcatgagaagacgcgctcatgggagtgcctccattgggagtgtttccggtcttttctcccttgccgagaatcttgcgattgtaccaagtgggatgatatacggaggttctgtgaatagccgattgcagaaagtagtagttgaaatgtacccacagagagttgaactgcgaatgccactcgacaatctgagatcgcatcgagttgtcagcctcgtgaacgtctgcatagcccttggagcaatcaaagaccatgacatcagttccaggccgaagatgagcaggcagacactctcgccattgagtcagctcgcgatcaagcttgatgatgcactcggagatcttttcgggcgacttgcgtgcggcggatgcactgtagagttgactgtacactttagaggagattcgagacaaaccatgcaacaactgggcatatgacgttttgtggccgtcaccccatttgatgtaatcaatgccctcgtcatctccgacgtcacacgagtccggcgacggggtggaaacgtcgttgtcgtgaatgacagggggaatacctgatcgtagagacagatctcgatccatagtgtacaccaaccaccagtttcgcattctcaaccgagccacttttggtgggaggtgcgtgtatccttctcggcgatgtaatccgagatctatagccagtctagctgctgtgttgacggccaggtgtactccgtgaggaataggagtgctgaaaaagtacatggccaaaagaagagtcccctgaagcgcgtggaaagaccctccgagggacatgatgcgagtgtagaagaatatcgaatttgccagggcagcttttctgagcgtaagtatcgactctctggtaaaacaggcagaagctaccttgcattcttccaccaccgagtgtaggaagtctgtggtgatgagaacgagggtccagaagaggtagagctccgcgtagccattgggtctcgatccgggcttgttgtagaaggctgccacaatctggttccagtcttctctgtccagaataccggaaatgtagttgacggcgtcaaagaagtggttggtcagggcctccacgtattcctcgggcatatcgggtagcagcggctcggggataggctcgacgaagtctcggagtttgagatgcatctttgaaaatacctttgtgaagactccgagcatgtgttgtttgattcctggcgatcctgctcgatcagacagccattggaggcctgagggcgagaagacggcgaagacggaggatccaccgaaggctcgatcctggcaccgttccatcgtgtgcgagaaggtgtctcctcgttgggcggagctgggggccttgaacgggtagatgaaggatgttgattcgtttttcgacgaagttcggggttcatcttcgctgttttcgctggtttcgttgtcggattccgagtcgctctggggagacgctcgtcgagacacaaactcggagccgttgtgtctgagaatgatgtctgcggcatctcccagtcggtcgtcacccagacgtcgtagcaccttgtcgagcagcgattcaattctgtcgaggcgcgacttggacgaccgcgagttgttttccttggtcaccttggccttgcgtttttgcaccacctcggtgtacatacagtctcgacccgagcccagacagttgttgcaggccggtctctggccgtcgcatcgggttttgcgcttgcggcagggctcgcacgcccgagacactcgcggtttcttggcggtgtcttcgtccatggtgagggtggagaagttctggtactgtacaggttttggaacaagtttgcaattgcaattcccgctcttgatctttaaaattgactttggcggggtcgataccaaagtggatgtgaatggttgctgtgtgagacggattggtggtgctggcggtgcggcgatggctccgattggcaactctgctttcgtgtcgaccgctgccccggaaaagatggctactgtttacatactccactacacccatgcaccttagctgggtggcgtagctactttacatgcaccctgcacccatatctctgactaagaaaaagtgcagcgccggaacaatggccaaactctgtttcatgaggtgggtgtggagtggatcggaggcggaaggcaggcatagtgtttgtggttgtggttgtggttgtggttgtggctgtggttgtggctgtggttgtggttgtggttgtgggaggtcacgtggtggtcacgtgacctcaggtgtcgtccgcccctatataatttgtgcggtgtccgcccaacagttactactgtacttgtatacatctcctccactttgacggtcaaacgagcgataaaaaaggataaaaaagacattaaaaaaggataaaaattaaaaaacataacataaaaaaaaaacataacataaaaaaacattttataaaaaaagtttcggatcggagtatacacctcgcgcagcccaaccgaaaaacctacggctccagtggggccgtcagaatgacttgatagatgacacaaatcggacggtggttggttctatcaagtctctagaccattgtgagtcgtcatccacatgcagacaacggctctctcgacaatggtaccttccaaacccgtctatactaccgtacaataccccacaatgtcacattggctcgttagccgcattgtattgtaaatatgtacgagcctcttccgtaagatatttgtcacggattaatacgaggctgacgacagtgtacgtcttggaggtgataaagaagcgcagtgataaagaagagggcaaggataaaaagagggcgaggatgaagaatgagggcagtgtcggtgcatgtggagttattctgtgcagtacaatgtgcgtacaatacaagtgccgtacatattctactcaacggcgtgagttagtggtattggtacagtacatacgcgtattctatcctcctatccgcgcgtatactacgagtatgtactatacgatatagtgtacggtatataatgaacgactatggtatgtataatgtattatgtataatgtataatgtataatggtatgccagacggtcggttcataaacggcgggttattgtgaaccagtgtttgacaatagcaatcatagctggtgactatagacagggctgtctggtgacacaaccgtccagcaacattcatcgccggctgcactttcaacaggtaagtttacccgagatgatttcgatgagagtgagagcgaaagaagaggaaaatgggcgatccgaaaggtgatgatgactaagcggaaaactaggtcgatttggtgttgcacgtgattgacccagaaatacaatgtcacctacaacagattagttgtgatcgtactcctataagtacaccgtagagtacctactgtagatcagtctatctctgactttcgtacaaacattactttttccacagtttgcaaccactccgcaaatcacgcacaatctcaagacagacagctatgacgatcgcctcgtttgccagggtggacatccaggtatactgtcgcaggggagctgggtagttgctgctggagattggttctagtaaagtcacaactacgaggagagctacgaggactcgcactgactaatgtactgtgatcgaccaaggcagtctggccgccactgctacagactttctgagtgcttccgacgctctgccactcgcattgctcgtcatctcgcagctcactaagttgttccatagcagtacggaagcgcggatacgagtgaacacgacgcgtgtaatggacgctggtggtaagcacgagaagattgatacaggtacggtgcttgtatgtcgataacggcccatactgtcaattgacatctccaagcatcagcggttgatcagtgaactgcaaagcccgctattcacaagacaagcaggatgacggtataggtgtgtatagtgaagctgtgggaattccttcgatacgagtacatatgattgtacttttacactgcaagtgtcagggcagtctcactcactgactgaagtttcacaagctccatcacacaagctcgttcaccatagaacagatatctacaagtaccatacatctcttttgacagatgcggcatttcttgagcactataacagctaagtgagggttttctgaagttgctcagacgttgcactacagagaagagacgtcatatccacgactttggctctcctctaggatcagtgcacgcaagtccacgatattggagaaccagctatgttcgagtacgatactcgctcgcaactgctctgactgccctgactgccataccttggaggtacccagctaaactgtggaagaaatagccgcgaggcatgtttcggctatagactgtataataatggtgaatggtgctacaaaatacaaccactacagtctacatgctcatgactggctttcgttaaatatgcacttgcttttgttttataagacgcgttcaaaatccttagaacttcttgccgaagaggatcatctgcatctggtcgtacatggagatgacaccggcaccggcaacacctcggagaatgttggcaccgcagcctcggaagagagaagcaacaccctcggccttgacaatctggacaccgcagtcgaaggcagaagagtacttgacgccagttccggaggtcatcatcattcgtcgtcggatggtatcgagagggtaagaggcggtagaagcaccggtggtgacggtccatccgagcaggaaggcggcgaggaagttgccctcaagaggaccaacgagaacaacgggcttaagggagtcgtagagaccgaagtacagacctcggtagacaatgataccgacaacggagacaccgaaacctcggtagagaccggcaataccgtcggaggcaatggtctttcggtagacatcgatcagaccgttgaactgtcgctcaccagcggccttaccgtccttagcgacggacttggcatcgttggcaagtcgggttcgggcgaaatcaagagagtagacaaaggcaagagaggtggcaccggcaagaccaccggaagcaaggttacccatcatccacatccagtagccctcggacttcttgaagccgaacatcttcttgaacttgtccttgaaggcaaagttaagagcctgagtggggaagtatcggatgacgttggcggtgtttcctcgccagaaagaaacaacaccctcctcggcggcggttcgcttgaagcagtcaatgataccggcgtagggtcgagaaagtcggccctgcttgatcatctcctcctggttctggatgaggagcttgactcgctcaataggagcagcagcggtcttagagacggcggcggaaataccgcccatcatgaagtcaacaaggaagtcggacattgtgtgggaatgtggcgtgatgcttgaagaagaaagctgtcaaaaaatggcgctgggggggtttatatatttgccattggtatggaaaaaaacatgcacatgcatgtacctgggtgaaggggacaccaaagggggggattaccagcctaatacgcggccgattcgggccgttggaccatcgaattgggtctatggagtgcggtcatcacatgggcaccgtttttatttcgttacgccttcgtgaacccctccaaaagaccattctccgagcccccccaggcccgatattgtgacaccctttggcacaaggtttgcacaagagccggacgtgcaaaaactctgttgtgaaaaagaaatgcaaatcagggctatctgagacacaagagggaccggttgggggccgattttcgcggctggagcaacgagtccgacactatcgtgctcaattcaactcaatcggaggtcagcgggcccatttcggggccccaacggcgactttcggacctccgcaatccaccagtcatgtgcaaaaattttcacacacaaggttcacaaaaaacaccagtggaaaattcaattccgaaacccgaagctagagttcgtcgtacccaaaaggtagaaccgaagatgattctggacggaggatcggagctgaagcttcgcggaggcgatggtggcaatgttcggcggatttggagccacatccttgtcttcacgccacggtttggggaccccaaagccccccaaatcacctatcaaaacaccacatccacttacggacacacgcatgccaaatacagttttgacctggaacctagcgttgagctgcttgtttgggcggaagtatcgggcgacctcgggtatctgtctgacgaatgggagacgcggatttcgagtgggggggaaaagaagatgagggtcacgtgacccgccgcgtgtccgaggatgggccacgaaattagatggagctgcggtagggcgaaattgggctctgttcgttcagcatgtctcagctctgtctgcttatagttatagtagccattgtcgacaggagttggagctcagtctgagttcaataagccccaaaacaaaagaggccacgtcatttgccgattggagcgcactcgactgtttctcgtgttttggcggttcgcaaccggctcatagaccgccgtttataggtcacactaccatctggagtctcgttttcagggttcaaaaagataagcatatatcgaagagccggtgaattttaaccaccaatagtgggaagcgaattctggagcaacacgggctaactatcaacaccaacggtacaagtagtgggaaaaagacacgaaaaacggaaagtgtcggatcgaactgatcacgtgaccgcggtggtggctgtggcgcggcattcgggttcacggcgacctgttaatctcgttttcatcaacccaaaagggctctgcctttgaatctatgaaaccgtaacttaggcggctaaaaactttggcgatgagttatcgcctcgtggaggtgtgcgtctagggtgcgttctggatggggggtatgaggagcacgtcccagttataggggaggtggtatgagtacgtacgagttgatcgggaaatggggacaggttatgaagatgtaggggtacggagaatgtgaggtaagaaacagattatgaataccaagttccgggtggtgtgatcagggtcgattgagtggagttggagaacttggcagtgaggtgaaaaacaatagcgaaaagcaagacaagttgttcggcaacaagcccgatctacggagtgggtttgtctacgaggttgtcggtaacgcgactatgccaactgttttgttttggactccatgaagattggaaacaaacagaagctgtccaaacacgacaccttcgacgctctgaaggtgactttgttgttctcagtgggtatcgaggctctgtattttgagatgccaagtccaagcgtacaaaatggatctctttggcaagtctgtagatgatcagcactcttgtaattagacgaacatattcacggccaatttgttggttggttcagctcggaagacatgtacaagcctcttcaacgaatgacgcaactacgagaccaacaagtgagcgatgatatggcaacaggcacgacaaaaacacacccaaaacacatccaaaacacatccaaaacacacccaaaacacacccaaaacacacccaaaacacacaatatgttcccctactctgtcatacctgtcactcactccgctgacctcttcggttcgcgtcaccggctccgactctccacccagcccaaatcaggttacctgctttcatgtgctcttgcttgggacacactcttcttgtccctgtctcaaacagaccacctctaggtatttttaccttgccttttcccatattgggtggatttgtcacagcaacagatcattatggtatgtacataggtaagtctgcagtgactgcagtgagacatctggtgtcttgtattcagtgtcaagtccagaaaacttctgtgtacagctggattcacttatgtatacagtacaggtacataaccagcaatggtgcccgatggggaaagcacacttgcaaatttcaaattaaatttttagaatatttccaaaaaaaaaatccaaaaaaaaaaaccctttgatgtccgaactcaaattctgcaggaatcgggatcccaatccctaattatagtccacaggttggcgcaaagactgtacttcagcgatatgacaccaaattagctggcgtaatttcaaagagtgcaaaaacatagagtcgagctcaatacggacgaagacacaccacagtttcggaatatatgctcatatttctattccgacctgtgtagggccagatatgagtgtctgaaaccagaattcaggactcggccatttttgacaaattgggacgtgacgcgaacacccgaggggacaagacgcgtgcgaagacagaggagcaggtaacaaaaggggttatatagaggagaacagcacgagtactgcacctgtacaatcatcgggcaatattcgacattcgagcattaattacatagacaattcaagaggaagggcctcagatagtcgtcctcatcctgccgacgcgccagagggcgggtacatggctggctctcacagacggtacttgagtatcaacgagtgagcataatacgttcgggcgacacgagaacgagtccactagaacgagtccactagaacaaatacaccagtcaccaatactacgcggcgagccacagcccccctcaacatccaaggttgtcgctagcccacggatacacgttggacaccccaagtgcagcgacagtctcctacttatagtggccgaagagacagcgcaaccaactgctacgagacgagaggcacaccggggcctttggaaacacctctcatggatttactggtgttctcctcctgactgcgttgtgtagtcctccagagacgcgttcatccagtgacgtctcaaacgtttccaaaagacatcacaagcagcaaggtggggactatcgtatgcatgctgggttggtcattcgatatattcactttcaactgatttttcacgcgttgacggtttccgaacgcggttttcgacggtggaggaatttcgaagaaaactcgagtaggtttccggagaccatgttctagagttttggacatccattttgagaaggtacaatgtgctgcacaaaaatttgtacgtgttttgcctgttggaaggggatgatttaattaccacattttcgggctttaaacaaattaaggtttgataaccaagttggacgtggatgagtacatgtacgtgaacgatttggtcgataccgtgctgttaaatgggtcaaaattgatgtcgtaggggtttgaaacggcccttcaaacggtctttgaatcggtatttgaaacggtctttgagacggtcttctgctatcatcaggtcagtatagcgtctgagagagaagccacttcatccccaaatgtggcagcggtggttccagttttatatttcgagtatgatggatctttccccaacacaacgttctggactcgattgacaagcccaatgtacatcggaaagattgacaagcccagctccaatgtgggggttgtgtttcctgggtttgttgtacttttggctgacagtccatatattatccttcttcatggcgtagatgaagtaaccacagggctcatcctcattgtcatttcccgtccttgcgcatgagaaacggaaattggcgttgttagtcttattccttttaccacagtatgggttgaattttgtcagtatcatcgtagtgaatgtccagttgatactaacacaatcgcaacagcagcgcatcgggtgtcgcacggactttcggccaccttccagactttgacgcgaatgcgaacccctgtgttttgcgaacccattgagaggctcccacatcatccactgagatgattctcggagaagaggcggatggggagttgccgcttttgtcttggcggatagtcgctggagttgaatgtgcttttgtgttcaatattgtaatgagattcaacagtaatgagaagtttatgtattttttggcacattcatataaagcgatcctgcaagtttatgcgttcatctaatatatatatataatttttttttgaatatatatattatttttgtcccgatctttcctcctccagagtgtgtttttttttttgatagacaaaaatgggtcacttacaacacaaaaattagtcactttcacaagtctaaccaggtttaagtttcgataaagtggacgggtatttagcactgatttttacgagggtacaagggtacgagggtacaagggatagcgcatacttgcaagttgtcctcggtgacatcagttttgtgaacagaatgctactaacagaaagcaaggaagaaaccaaagaatttggaacaaaaacccatgccatggtcgcactttcaaaaacatcgtcaaaagaaaaaccaactccatggcagcatcaaagagtatacagtacagtacattgacacttgctgcgacaggaaaagcccatgcagtcgtagagtagcgcttacgtacattctctgtcagtttcggtactataccagaagtgccatccagagttctacagactgacaaactggaagagtcgcaccttccgccgacagcgaccagatacagcactgttgaaagacattgaggataatgacacactaggctacaatgaagagctggttatcacaacggtaggaggcccttgtaaacatatacaaacatagctgatactgcgctcaccaataccgacgctgacgatgcgttgatggataaggacaggtagatcttctgatacagacttacaggacgttgagaccgcatggggatgaggatgagtatgactgcgattctgaggatacttgggaactacatctattagtttctgcactggatttatgaggtaattgtgctacatttgcatagcatagaattcacgctgtagtgtgtgtattcggatggattattgtgactggcgagttttctacagcccaaatagacccaatattatctgatattttgatacaagtacttgtactccaaccggcagcttctggcgactttctacgcccactatctacagtatgtacagtacgtatcctataaacaatatatagcaaatgatttttattgagagttgataagtagcactctgtgaagattatccatgcaattgatattcttttcgcttctccctgtaatatatatatatatattttttttttgtctattgggactaagtttttgttctcccagctggattaagtaggattttgatatgaagtcgatgcacggtgccagtccataccatacatacgtttttctcctgctagattgcaacacaaaaattggtcactttcacgagtttaacatggtttgagtttcgataaaaatggaggtgtttggttacaaagtgattcaaatactacaagtagtaggcactatttgtgtctgtttttttcacaatttccgacaggacactttcgtattgattacgtcatcaagtttttacccacttcattatattgcggtgtagatatgccgtagatatgggccattctacagtgtttgttcttctttgcctccccttcgtcacaaatttggggtcacttgcaacacaaaaattggtcactttcacgagtttaacagggtttgagtttagataaaaatggacatttacaagtgatatatacaataattagttgtgctcgtattgtacttgtactgtccgtttgaaaatggaaagggtatagtcacaagaacgacatgtctcagtcctgatcgtccataaacaaattacaggtctacgattgctcgagacccagatgcattccgcacatgtgaatgatgcgacgattgtttatattccaggacgtctcaaattggacatggtactcgactttgtcatcctcggagccatacgagctcctgtggaaggctcactggcagaggtctttcgagcagttcccaagggcggcattcgaaccgaaggagttcgcaatctggagttgccagcagctgcagaaagcgaaggggtgctctttgaaggagacagagtgggtgcagagactgtagatgaagcaccgcccgacgtggcgtgccctcttaacgaacgggtactctgggagtgactcatgggcagcctagagccctctgaaacggaccgggtacttgcactggacggaatggtccgctcggcacgtcgatctgtgctcagtgagaagcccacgggcttggtaggcggtcgagacatgttggttttcgatttcatgtgtcgaagggaatgcgatggagggatggttttggccgttgtgcttgtatttgtatttgtatttgcgcttgacggctctttctcctccttggacagatgcaaatcaaccaccttagagggcgactttttgatgggagaagacgtttccagagtgttgagcttgacaggcgacaggttcaggttctcctggttcatcttctccggcgaacgtagagcagccaggtccttagctggagacacgggagccatgttctccttggttggcgagcccagttgctgcgctgtgtgtgccagttcgagtttgcggccgaaaatgttgatttttcgacgcttggccgctgacgacaccacgtctcgttgtctggctccgtcagtgattttctccggcgtctttgcgtcgttataaatctccattcgttccggttcgcctcccgagcccgccgccgcagctctgtctctttgagccgcatagtggttgctgatggagtccatgtttttgaaggaccgttggtgggctcttccaaaccgactggtggctctagccgaccgtctggagggtgtgtagctggctgcgaccgccgcggcggaatttgacggaccggcgttgcgttttgtaggagacccagtgtcgccctgctcgacaatctgtttggcccggtcgttcatctccttcatgatggcttccgacacggaaggcgacattgacggagacgcgactccgaaagccgttccatgtttcattggagatcgcaatgagaagtccatggtgtagagcagctgtgtgtgttgttagtcgtccgtggcggtatgtgtgttagtcgtccgtggttagtcgtccgtggttagtcgtccgtgtcgcctgttttctctaaactggttctgtgtcgcaaacggctctgtttgtgtcgctactggctccgaacaggtcaaatgggagtcgagaaacggtcaatccgactcaagaaatggcgatggtgtggtgtttggagagacgtacattttgggttcagattatatagatagcatccgcttttggaaagcggtaaacaggggattaggggacgggttttgagaggtcctccaaccgacgatggagaggagatgtagaaatggaaaagctggaagcagaatattcggacctcgcttagccttatttccgagagaaatatccgactttcgcccacttaatgccgattgaacacggccatctggagacattgagttttcaccatgtactgtagctggaagttacagtatcacgactgtgcatgtatatacagtacatccgtacatatgggacattcacgctacagctctagttggaccctccaaaagtgatattatgggcggtgaaaaggggagacgttgcgcaagacgtgaatgtggctaccaaaataacacccctaatctgtcattgctccaataccgccaatataacgtcttctagagacaatcatctgggtgcaaatatcataattcactttaccctcttcactgtaaagccctgtattacgggtaatacaggaaagtgggctggacaagtaaaaaatataacgctggggacgtctgacagagctcaatctagaaccaacatttgtcattcatcttcaacgccaaatccgctcaattccactccacttgccaattctcagctggagtgtttgactgactcccacgccgacaggtccgatctgcccacctcttatctgcacagtgtcggtcttcctctctacctacacttatctacagtgcctccatctcgagaccggcgagctaaccacgcaccaatacggcagatcgacgcgtctgcagcatccacgttcgatatttgacgtcgaccttcgatattcgactcgcacacacgatattactcgacgggtgcattctgacaggccccgtctacagtacagcgtccactccacaagctccgtacacccctggatattacgggaatagtgtcgcaagagccacagacagcgtaacaacagctacagacaccaccacaactctctacagctctctacagctctctacagctctccacagcttcctgcatatattatcacggtcagtatcgaccaaaacaagcccgccgtcccttcgatggctgctccagactctccctccacgcccgacaggtcgtttgtcaacatcccggttcttcccccgcccaaacgctcgccccacaagtcacccaaaatcggcccgcagtctcccacgctgccccttcctccagtgcagtctcccatccccaccacccccaagtctgcgcttcggttcccacaactcgagccgcgatcccggtccaattccaacacctccaaccgctcgcgatcaccgtcgccgctcagaaaagtagtcttttcacccaaggaagagctcattgacggcggcaagaaatccaaagacaacttgcccaatttggctgatctgaaggaactcaaccagagagacctcaaggagctgaaagagcagcaagccaaggactttggtagcttccttagttcgccaaagacctcaacttcccctttccactcgtcgacacccccgccaccacctctgcatctcgatactgaaaccagatcccccaaaggaagatccaagtcagtaggagcagcttcgtcaccggtagatatcactccgacacaaacaccaatcatgcatacacccacatcaacgctaccctcctacatcaaccccgtgagtacagcgttctgtctaggtctggccgtgggtctcagcatctcggccatccgaccaactctcgaaaaagccgtcaaccacggctcctcgtggctcgcatggctcttcaaaaccgtcattctgtggaccgtcatcggtgcggcggcttacatggccttcactttaggcaaagctgtcctgatcacgattcaacagaaccagcagaagcaacagcagacagcccataaactgccccccacacctcgttcagacccctttgaaggtcttaaaccgaataagccatcgtcatcgagcggctctacggtttctgcttcatcttccaaatcagcttcttcgacaaagtcttctggaagtgccgcgtccatctacgagttcaacaagtacgttgatgagcaaaaggtgaaacgacggggtcagaaggacgaagagcattccttcagaccctatcctgcccgtcctcagttgtcttctacagctcctggaaagatttatggaaacatgtcataatccggactaactatcttacctcaacggtaatagtcatataagttattaatttcaaagaagagtgaacaagggaggtagatatggatagaggtacatagatacagtatgtacgtaagtacttacagtactgtacagtacacttgtacttgcacttgtacaatagtctggttatcctttagtggttcgagtacttctacaagtatgaccactgtctgttagtcagccagcactcataatgatgacgtcagaaactattgagtaatcgtagagaccaataaagaagtcagaaagctcttggacgctcctttactgttcatagagtgactttgcaatgttgtctgttccccggagataacccattaaggacgagttaactccggcagtgaaaatattaaagtttgggtgaaattttacgacatgtgaaggtggactgagtgtacacgtagtatcgtacaaggatgtggggagtgtaaagaaggcccttggtgggtttaaatgaggtggatatgactggatggctgggatgcacgtgttcgagtgatgttgtgaagtatacaactaccgttgggcgtggagagacggagagacgtgagaacaacatgttgaatatcacgttgtgcgacctccccaatctatcgaagttctgaacgtatgattcctctacttcatgagatgctctgtaaatactgcctgttcattagacagtgagtgtaaaccctgactgtatcaaacagagagtgactgcaagcacaagtattgtaggtctgtacatacacagttatcctatagacgataatacctacttgtacctaccccacaactgtgaatgcacagaaaaagaagaaaaatgtcagtttgatgcactcatagttctttacatgctctcagattcgaagcggatcggtctgtggcatttggatgacagaacagatacaagttaaccagccaaatgaggaggcttgcttctctacatatatttcaatccacagccaggagtgcgaagttgcacagaggtattcttaccagagctctacagatcacaccaataccttgagctgggtctcacagcgtcgtcatcagtctaatttcaaaagtgttggtcaccaatctacttcactcacagcttacagtcacaaccgtgttcaccgtgattcaccatgatcaccggttgtttgtccataccatcatctatttttactaacctgctatatgcacggcagccgccattttttatctacaaacaaaagtgttgcagatttagtagacctcgccctggttggcaggaatctcaaagacaaccttcttgccggtgagcttgttgtagacagactggaaggactcgagcttgttgtcgatgaaggtggagtccttggagtcgaggaaaaccttctggattcgagtgccaccaacctggtacttgactcgcttgccaatgatctcggtggggaaaacgagatcctcgaggagagcctcgtggaccttggtcagggttcgagacatgggtcgaggctgagagggcagagcctttcggccggccttggggaggattcgtcgctcagcaaggaagacaacgtgtcggtcggagaacttcttctcgagctctcgggtgagtcgctgctggatcttgtggacagcggggagggcggggacaggcacaaagataacgagggccttcttgccggcagaaacctcaagctctcgggcagacttgaactggaaaagtcgcagctcggacttgaagtcgggagaggagttctcgaggtcgacaaaggcctgggcgacctggagctcgagctcggaggggtcctgcttgatgatcttgagggcggcagacatggttgtgtgtgggtgtgtcgttcgggcttggggggaagtttgacttgggccagagtaactttgcaaaagtgccaggctccgcgcgtggtcctgtcccgtttgggacgttagggctaaccctagctgtatcatgtgataaaatcgactaaatggggaaacaaaaccttattccacaccctctcaaaagtgcacaaaagtgcaactacaatatcgatgaactttatggcatgactgcagatattgctcaacgagtatcgtggacgtttgtaagggttgtgatttgagctgatttgagctgatttgagctgatttgagctgatctggattggttctagagtctgatctagtctggaatcaatccagagtcgaatctccgcctgaggggtaatggttacggctcaatacgaggggtaagtacatactttaggcgacctctgattcagcatacttgtacttgtacacgtgtctcatgagatcgtcttctgtattgaatggatgcgagttcaagtgctcgcgtcttactcgtatcgaccagtaataccacaccaatcaaagtcagattcactcgagatcgcttctcgagccctcctgtcggcccttctccacactgtggggttagagaccaaatagtgtttcgttagcgcaaaagtcacgaggacaatggtgctgccgatacgagtctggtgccgcatctggtggaatgatgtccactgtgtttgcgcatatccaattggaaagggttgggttgtacaagtacaagtacgttgcaagtatccttacaagtatttcgtccatgttagtatcggacgctaaggtcgcttcttccctgcgttacgatagaaaaacttttgtctttacaagtcgtgaaatgtgaggaccaatgggagtaaaagtgcctcaaagactcagtgagattccagattcaaaataagactacttttgttactgtgagatcagtattagcgagtctatgttgttgtttcattcctacacagttcgttggcactttgttgaagatttgtggaaaaagtcatgactggctagaattgaaggcggagcatgagtatataaataaaatctgtttcaatctgttaattcacaccaagatctgacctcagaagaattgattttggccaaactacttcacaacgacaactaccgtagacctcccgcccacagtacctgtatcgccacaaatcattccattctgacccagatgtgagccataactcattagtgaggtactacttgtacaagcacaaggtacaagtaccatccatggatctggtacagtacggtccataagacatactcctcctacgactacaattacagtgtgtactgtagccgtcctagatcatctgccagacgccaaatctacccacactgatcgctcacttgtaaatccgttcaaacctatcatttcgatacaaataccgtttctcatcatgtccgtctgtctcatctttgcgatattgtggacatgcaccaacatcgtatctttatgagacagttggagaatacacacacttgtggtgcaaggatcggcttatacgatgtggcaagtgaaagggagtggtgtatgagattgagcgagtaggagctctcctattcctactcctactcctactcctactcctactcctactcctactcctactcctacctgtatgtacatactgtactagaataatgcagtttccatcgatgtgaagctcagtggagttgtgagccatattgagagaccgttgcaaacagatatccagtgctctatgaacaacatacatggattaactgatggccttttcatcacggacccacataaacctgcttgacgatgatgcctgaaatttcacaggtacatactacaggcttggcatgggccgtggatgtatttataggtccgatcggcgagtgagcggcgagtgagcggcgagtgagcgacaagtaaacaggcgtttttcggcgtatctgtattagaactgttaggaaccattcaaagtgggtgtcaatattcatgtttcgtgtcaattcatgtatcgtgtcaattcatgtatcgtgccaattcatgtatcgtgtcaattcatgtatcgtgtcaattcatgtatcgtgtcaatacttatatctcaagtggttgcatcgcaaacagccatcgcatactccactctactctcactgagttcactcttacccggctccaccttctagaagccaccaccgatccaccgacgatgatcagtccaccacttgctctgaatgtgcgttggagctgcaccatgattgatgacgtcaccgccattcagatagggcaaaagacgagcgccaatcgcaacaatgggcgagtgtcgacgactcccccgctctctgcggtttcagcgactccaaccgtcgccaaaagaccgtcattttcgtctcaagcgcagcccagcccatctcttctaaaagattccagaaagatagggttcaccaactacgcaccaatatgtacagtatcgtagctactccggcttggctgatctgagagatagagacggctccgagacgcggaaaacggcggggtcggaccgatcacgtgacacgtactcatccgtcgcgccccgagctccatttcaacaccaaatactcccggtcacgtgccaccccgcccgctctacccacgagatgtttctacactatacactgccacgccgtcatacctgcagctaggttaacattcgattaattagtggagtcaccagtgtacaggactatggcggaaaccgggttacacaaaccggcccggaatagcagcattataccgctggacgagatcaccgtcaataaattgcgtcgttactcgggacaaccattgctcctccggctacacctgctcaaaggacttgttccacactcttccccagctctcccacgcaaacaaagagagcaaccttaagtggacagctcatgagcactcccctcgtttgctgcccacgctcgattatataaagaccagcggatccccttctatttggacttgcatcaaccaaccacaacccacaccaagcacacaaagcacaagaacaatgtcccagaacgtcaagatcttctaccagcctcagtacgaggaccgaatctgcgagaacggctacgtcgtcttcgtcaactcggaggagtccctcgaaaagtggagagccgacccctccaccaacattgtcaacattgtcgccgcctaccaggtctggaccaccggcaagcagggagtcaacggagaactcaacgagccctccaacctgcagctcgacaccgactggggaacccacaaggtcgacgacattatccccatcattctcaaggagggctcctccaagggctccgccaacctcggccacaagtttggaaccacaaacgcttccatgggcccccgagtggcccactaagatgtgtcctgcgtgacaatgatcccgtcttctgcatgaatcggagccaccacctcgctcgtgccctccaatcaactcaattgaccatctcttcacacacaaacacccactcaatgcccctcgtgtggccacaaatcgacttctgtgaatcgatccaaagcctacgtcgcattgagcccaacaaggcaaactgccccgccatctaatggctcgcaaaagccctgcatactaggactcaccgtcccctctccagtcagtcatggatataatttaatgatattatggcttatgaccaattgtacacgtagaaacgacaattccaggtacacgcccgccgccttctgtgtctgccacaaaacacaaacgtatttacgtacagtaccagtacattagcgccgttggtcgtgtggggtcacaaccacctgccaaaataaagtttatccaacatatatcaaacgcccgattgctctctatctagcaatgtagggttagggttatattaaatccggtaaaactcaaacctaatcggaaacaaggagaccctacaattaaggttaccatgtactgtatcccagaaacaccgtcatgatgtcaccgatgataatcatcatctgtaccagtactcgtacgtattagagctatatacatgtgtttcttttgtcttctttttaattggtcaaccaccctaatgatgatgcttccataccttggtcttgaaccgacgaagacgctcgcctgccagcttaaaagtggggaaccgagaacttcgaccgagctcgtcataaggagtgttgacccatacacttcgagcttgcgatagagcgtcaaaaaactcatccgtcccgctgctcaagtcgtacttgctataacactccttggcactgacattgtcatgcggaaggctcttgctgcggttacctccaaagacacctcgtgctgacccctgtcgctgacctccccggttgaaagtcgatttcatcgaggccacccgccgaaccatgtggcgcacattgttgatgggctgataggtatcatcggcgttgcaagaggggatcagaggcaggtcatccatgctccaaatgacccccagagccttctcggcctccagccgggcgtatcgtcgaatgtggatggtctcgcacttgatgccatcgttctcgtcacgcgtggctgccgtgtgtgccccatagttggactccaggtctccgtcgacataaaagtgttggatcttgagctggagagccagaggatcgctgaacccgctcctgtagcttccaaagaagtttcgccatcgagaccgcttctgaaaagcaacggaaagaggcttcatgggaggaatccacgatgcactgttgtacccctgcagactcatgtccgaagccttgaagtcccacatgtagattccattgacggagagaatctgcacctctagcttctcctgccacgacttgagctcctcaacagtggttgcagtcaacagaatctcgtacagaccaaagttgtgctcgaaaatcagcttcttagtcaaagaactggaggtttgcagaccaacaactgagttgatggggttctcgagacggcaacagtgcagcggaataatgaacttgacgtagaagcgaccctcagggttggcaacgttggcaagaatcaagtaggacttgaagagaaagcatcccatgtagtgaaacttgatggagccatcggggcccagccaggtgacgttgagagcgccacagagaattgcaaggccaaaatactgcacactgaagggcagctcgttcttgaagtaaagactgttccacaaaatgtgcgactggcgacggaaccgctctacaagatgattgtggtcaagctgccgcagcttgtcctccaccttctccagcgaatcgagaatcacaaggtgagattcagtctcctcaaccggacaagtgtttttggccagctgctccagaagtagcctgtacttactgatccgtgcagcggggacaatcatcaggctctgcagggagaggtcctttcggcgaccatcatgttgagctgcgttgagcaggttctcgcagcccttgatccagaaccgctccttgcccgtaccacggtaggagcgcagaagctcaatagtggcgtcgtaattgatgcagtattgttcgtaaagatagagactgatggcctggtgttagtaatgttgggggtatcaaagaataggtatcacaagaaaaatactcaccttgtctgcaacaagctgactgatgcgggcagcaaactggggagaaagagtggtgagagcaggcttgacccactttccatctcgataccccagattttccaaattgctaggagggacatccttcaaagaagtccacactgctcgtgtgaagtcgttgacaccaggggtaattttgacctgcagcgtgggggcagcaggcttgttggagatggtgatgttgggatactcggactgaatatcatccagtagctcctggtgaaactcaatgagcgaccgtgtatcgttctccaaaagagcaacagcctccttgccaagggcattgcacgactcaatggtggcaaaatacatgttcgccagcattcgcagagagctcaagtagctctcctcggaaagaatgagctcctggagacagtggctccggcgctcctccatgagagcccgatccttgggagcgatgggaggtattcccatcgtcgagatggacgcagcaccgctggcagactccatgttaatgttgtgcacaaggtccacgttggacatgtggctgagggaccggtgtacgggcagggggtgaggtggcatgtcaccaggagtgggaagagcaattgttctgtctttttccagtgcagaaactgcagcagtggagtccacctcgataattggcgtcatattgttctgcatttcctccttggtcatggtggagatcttgggaaacgtgttgagcgtgtagtcgaactcgtccgagccgtccagaaacagcaggttggcaattccaaaatcctcttcttctccagatgggggtggtggggagttgatagcgggctcgacggatccactgtcgaggagaatctctgtcgtttctggatccgtgttctccgtgtacacgcagtaatcgggctgcagggctgccggcttgaggacaacagaggacagtggagatgctacgagctcttggggcggctgctgcaagtcctggagagtagtgggtcgtggggacgttgtcggctgctggggcgtgagagtcttttgctgtgcagctacaagaacctgggggtcaatagtattggtgatggtcttgacaactgccttctccgggtcctggaagatcaccgggttctccaggcctgacaacactgcagacgagtagggagagtacatgctttcttggtttcccgaaaaagccggcgactgcgttctgctgctgtttgtaaccgagttgtctttggggccgactgcgctcttggtagtttctcctgagtaggtgctgttgccgacgacggcgagtgtatgggcggagttgtttgtgaaaagagcgcttcctccggtgccagcagtgtggaaatggcgggttgatgcttgggtggaggcgacggtgagggctccacttttggggtcgtcaaagactgttgtagctccggaaagaattgcctggaagggtttctggataggaggagcctgtataggagttcctgctcgctgaagaggcaccgtctgtatggtgggtagcgtcgtgtcgtgtttgtgtctacgcagagatcccctcagagaccggatggatcctcggatcgagccccggaggccacctgtgttttgtgtgggtgcgtgggctgttgcttgggggaggtctggcggcgacagaagcaagacggtgggcacaaaggtggtggaggaggactttcgttttcgggcttgctcgtagtggttggcgtgaacctgggtatccatagcgagtggaggatggagcgaggtgagcgagtgtttgttggatatgtgcaacacaagctgtaggagccaaagcacggtacaatccgaatatgggtctgtttaagagtagggtgatacaaacagagcccttaagtaaggtggtggttatgagtgtgtgttgctgatgggtacagtagtatacagtagtggtatctgttttacaggaagctcgacggtatatatagttgtaaaaaatattattggtatcagtcatgtcacagggtatgtcatgggtgtgtagacggtggtttaaacgggtgcgactactcggacacacatactgatatttacaggtctgtcacgatgtactgtactgctagcatgaacttagatctgcagctttggaagcaaaacgaggcatgtagtgcgttgtgtggtgggtaggaacggagaatatatataggggctcttccccccctccccccccgttttatttcccaaaattgtgtcattacaaatcagtttggaactagtattgctgctttcaccgccatgttcctattcaccttctccacttcttcccccacgcatgcacgattttaaagcttaggcgagtgacatcataatcacatcaccacacaacccgcacacaactacttaccaccaaacatgtttctgagaactgtccgaagccaggccgtgcgagcagccgccctccaccacacggtggctccggcactatgcatgcggcccgtgctccgaacacagacagtcgcgttctcgtccactcccgtgactctgggcaagaaaaagaagggcggtaaggagcccaaggctgctgccaaggccgcggccgaggaggccgtcgatgaggatctgttcatgatcgagtggaacaagtttgaggacctgtctgccaagtctgtggctgcgtttgccgccaaggccaaggagatcaaggccggaaacaactcgccggatctcatcaacaacattgaggtcaaaatcagcaaggacgaggtctaccagatcaaggacattgcctccgtggccctcaagggcggccgaacgctgtccatctccgtctacgaccctagccacaccaaacaggtcaccgcctccattctggcgtccgatctcaacatgaacccccagccccaggccaactcgccccagatcctcaacatccccctgccccctccctcggctgagagccgggccgagcagcagaaggagctcaaggcgctgtacaacgccttcaaggccgacaagaagctgacttcgggtctggctgcgatccgagacgccttcaagaaggaccacaagaagatggccgaccagaagtcgattggaaaggacgtggtcaagcgagaagacaagaagtttgaggagttgcagaaggcatggacctccaagatcgaaaaggagttcaagaccgtctccgacgagattgccaagaagtgatactccagctggggatagttgtatatagcaatgtattatattgtacagacgtggtggtgaggttggaggtgtttgcagagtatttgtacgctacatacgggcacttttaccatcaattgctctcatcaatacatcggatattttacgagtaataataaccccaaatcgcctacacgaggaaactgaacgtgcgatattaaacatacgaaactaaacatctcagcgcctataaatcatgtgaggatcatgtgataatcatatgatgcttcaatcacaaatctgcttcttttttcctcaaatatcgacgtgtttttatccaccgttctcttctcatcccgctccactctcatcccacctgcaaatcctaatcgcctgaatgatgattatggaaatggcaaaatgagacaattcgttgatgaaaatcaacaatttatactataattcgacagcccaaccgtttctctcacacatcaactttctccccgcttcttacctccaatatcgaacacataacaaacatcagaaatcccaaaatgttcggtcacgtgactttggtggaacaagggtaaattgaacaggttatttttttagcaaaattcgcggtcccttggcccagttggttaaggcgtcgtgctaataagaaattagcctctttgcaacgcgaagatcagcagttcgatcctgctagggaccacttttttgacgtgacaagtgaagttgtagttgacgacgtgtgtgtcttctcttctcctcgttctctgtatctttttaatatttatttagcccgtctttactccttgttttgttcattttagtccgtcaattacacttgcgcaaagtcaatattgcattgagatttttagggggctgttttttgacgaggcagtgattgtatgagcagtggtttgcgcgagtgtacggatgtcacattgtttttgtcactgttgaaatgacataaatacccgtggatttccccctttcgagctctgacgctcaagacaccggcacaatcacttctctcgttgagggtgccatcataaaatcgccaccatggggccatgaccgacagtactttcacgatacgaggtcaatcggagacggtcaggagagaattggcgggcaattcagggcgaattaacccgtcaacaactgttgtcacggtgccaacattcaattgcaacgttcattgtacaattgctgtgacgagtccacccagccttactcgtgtctcagcaatcacaagctacaagcacgaggtcttgtatctacgtgaggaaaagagccaatcgtgagctcatctacaatacagcatcaccactcagcgttgacgttaaataattaagtaagatccatgggcgcacagcgactcttatctgtcctcggcccactcgttctctcgtcggatctgggcctcctcctcaggagtgaagtcgttggcaatgttgaaggttcgtcgaatctcctcgggggtcttgcccttgatcatgttggccaccgtcttgcagcccacgtccagcaggggcttgatgtccaggtaatttgcggtcagaataatctcaaacaacatttcctggtccacctgcagaaagttgtaatcccagtcgtcaatcacggtgctcttcttcttgtcggcggccgaagtgccctcgtcctctccgctctggggaagagggtcgtccttgtggtaggtgcagtactcaatcaccttcttgagcacattggaagacacgttggggacggggatctcgccggcgtcctctccaatgtcctccatcatgttcttgatgagggccgatcgcgacgcaaccttctggtccacgttgaacgagacgccgtctgaagaaacaagagtgaccatttttctagttgtcaatttgtgtgtagttggggtatggtgtggtgtgttatctcatcccgaaacgaaaatgacacagacaacagcggaggcgaaagtttattttggtcacgtgaagtggtcatccccatacaatcgtcgtaggatcgatccgctacttgtagaggatgggttttgagaggcggaaacgacgtatttataataaatacggcggagttccaagttacacaaacacatgtttttgaagaagaagaaaaaaactcgcatatgacgcaaaaaataccgagttatcaaccgaaaaaggccaagtatatttagagacttgactcatgtgaaatggaagagagaaagggattttttcttaggaaagaagtgtgtcaggaaggagttgtgcggaaataaaatgatgtgaactgagtcccgaccgtgaagttgtattccgccgcacagatgtactcatagttggattatgtaatctgaatgtatgctccagagaatagttactgtataaaaaatgtaggaactgtgatatacctgtgctgtactgttatataggacaaggcggatgttaaaaatgggtattaaagggtgatgacaattccattggtcaattgtctcgttttgtccttttttttcccgttatttagccgtttcaacagtcaccatactctggctaaaatcccttaacaattaggggtataaatgtctaataaaacttatatttacttgaagatataataaaacatcccaccgacacaacgactaagactcacggagaacaggggttggaaacagaacatgaaagtgacaaaaagatgtacaaacattgctttggaaatgagataaaaagtaattgcagcacccaggattctcgtatggtctcccactacaatactaactgggctctctggtgcttgactatggctgatcggacgggaagccgtattttcaccaggatatggccgcaactgacaaaattagtgcaagaatccatttacctggtctaacaagtcacgtgacaaaatttggcaaaaacaccacaagaatcggggatgtctgttgcgtagactccccttctcttgcatctcttgcaccaaggaaacgtggatctgagtctgcccgatggagcatcaaggatgagagatgtgattgtaagactcttacgtaatgcagcctggtgaatttcatgaactgtctcgtttcactattggcattttataagtccatgaggtggtgtagcggacatcacagtgataaggcagctgctgcattgtacgtgcagtacgtacatgtatgtactgagtatcatgatgataatacagtcatcataatgtcttgttaagttgctagacaatcattatacacacaataaatactcacagcacagcatttcaactacaagtactgtactgtatgtacttatgcatttgaacatagcaatacattaccacaactactgctcaagacccgccgactcatctgttttccaccgcccctgcagtcgacaccagactaggagtggttgtgtgctcctgagatttgaaggcaagccatggatatacctgacaaggaccactggttgttggcgatgaacgaggggtggacagcaaggaagtcaggggcaaaaaggtcccttcatggtgggtctacaaccggaagttcaatttggacggttagcttgagtgatacaaggctcggttggtcgctaaatgtttcgcacaagaggccagcatcgactgtctaatgctattcagttcagttttcggttgaatcagtttgatttcttctagccttcactgcattcattcaagcagtggaacatctatcaaacggatatcaagatgatcaatttattcagtatgaactgaacagggctcaatacccaccattcgcacaacgtaccggtgtgaatgtactagcgactacgtgacttttctgggtctccatccaagtaaagaggtacattcccaatatctatggactggacactccatccaagttcaaatatcgctccaaatgggtatgttctattcattttggtctctgtttgtcaaaacagtcgccaaaactcgccatttatggaaccagaaagatgtaaatctgagcacggaaaaactggctggatacttggactacgagtataagtgctagtacagaacgtaccccaagggtagtgttcctgtgtccgtttcaggactgtggcatcgacctgttaactaatactcatactgcacctgcattacgtaagtgtagtccatcgttgacaaaatcggcaattgacaacctacaaaaatgaaaccaaaacagtagaaagcgcctcagtttccccttccattatctttcatcgccgacgagacactgcccatatcacgcactgcgtctccacagatgctgacaacctggtacagttttaaaacacgtactgtatgagccccgcgtcgacttctcctgattattaggagggataatgtcgaaaattctatcgtattcctgtttcagcgagaaataatgaagtggctgggacaaatcggtggcttccacaaaatgtgcagtattccctgcatcacgagatagacaggtccccggcgagacttcacagggcagtggtgggggggaaggtgaccattttcgggtaaatttctggcaatggagctaaacaaacgccatcaaagagtatctcaaagtccccgtgtctccattacgcatgaagtgtacagtggaggtgcactgagcaggatgtggtgaatcgtgctgtacgccaaagtcatgactactcgagagatcttctgcaagtggaattaccaggtatcaatcccgccaacagcatcaacccaaccaacaatatcaacacaaacctgttttgaacgtactcgcacgttccaatctggcaaagtggaactaacagcgcttaaaagtgttgtctcaaactgacggggtaaagctggtggaaaaccagtgtttttctttctcgtattgtccatctgaacacgaacacacattgttattatggctacaagtagagagtcgacgcccgtaccgaccaacaaggccagaagggcgttgtccagactcaaatccactcttaatacgccccaactgattcctaaccgccaagcgaccccgagaagaacaccagcagggacagttcaaataaccgctctttggctatggtgcagttcaaaatcccattctattggactcttacaagcagtatatccacacctatgtggccaaagctcttctctccgtctacagctacagtcagcgctccatcaactgaaagatgaaggtggagttggaggtgggaaatcctgccgatcctcggactactacttacaagtcttcaagtagtggatgggttcctgtcaaatctggagaagtgaaggccgtggtccttcgtagccctcatattctcaatgtcaactgcactcagtggagtgaggtgttctccacaattcgactatgcaatatcaagtctctgggactggaccacgaagcccgggtttcacgtgatatgaaaacctgctccagtgcactggaaaaaaccaatcaataacaggagcttctgggagctctagaatgtcacacttcttggagattggacaggtttgccgatatcattaaagataaacagtacctggaaaaaaatatctctcttctcaataataaaacaaaaacagtatagaaaagctacgatggtcagctggagaagttgcaaaaagtcaaccgaagccatcttcgagccagttccaaagtctctagtctcaaggccgtcaagaaccactgaaaagagctggggtccctcacgagtcagctcaaggaggtgttcttcaacaaaccggaggttgtggagtttgccgttggtattatcaagggagagtcttcgagccccgtcgatataatcagcgtcatggacagatctgcgatcaaagtagccagtaggtcgccagaaaagcggccttccacgacaagtgggttacctgccactggtaggtctgaatcgggcctattcgtgtcgcaagatggatatctgagctcttcagcaagcccatttccggcgtctatgttaaacccgaggtctagtcagtctacgacgatcagagtcctcttgagaggctgctggaccttcagatccagacacttgagaaggagagcgccagactggggagctgcgaagtagagtatgagctggaccgggctaatttcgctcttgatttcgctaacgctcatcttgacgcattgaaatccaagataggaggactagaggcgcagtcgcagctaaaagcactgaggagagagcgtttaacgtgtcgtccaagaaagagagactgtcgcttgcggaaaagaacccgaatctcgaagccggtcacctcgtttctacttcgtgggagaaacggaaggagaaccacaagaacaagttcattgggttccacacgggcacacgagacctggttcagggagagggattcatgtccttcatgaaacacgcgttcaaagactcaacaagtaccatcaatagacctctccgggcacacattggcttttcccccaaggcgactagcgaatctcagaagctgctggtgctcgccttcttgaaagagcaactggccacgtttttcgtcacctctgaggcatacaagaatacttggagtctttcaacaacaaatttggcgcctccaaagtgaacatagttgttcacagaagctccgctagtggtgagatggaatctgaacacctgaagagcactattctggagctgcttgatattgacagtggtcatgtccaagactatattgtttcggcgatggatattgacaaaatttgagtctctcatctccgattctttcccgaccagggagatttctgggaccccgtatctcgtgaagttgtccgagaagcagatcatatcagcgggagctccagtactcgcactggtacgttgattgtcagcgacgactatcggtatatctttcccagtcccactagagaagagtttgacaaatgttcctagagacttgatttgcggcttgtaaaggcgttcgagagcgagaaagacgacgtgaggaccggattccacaagcaaaaggaactgcgggaactcgagattggggcccaggaagttgtgtgctcaaagaaggaagggaagagggctcttacactgaagaacccctgtgaagttcaacaacacagtgacagtccgggctacgttatttgccgtattcccaggctgaaaagcacgtgtctggagctccagaagaatctcgacgacaaaactctcaagtctctccagagagaggaatacgaactgcaaaggctcacagcccagcaacgagagattgatgccaaagtgcggccactaaagaagcaggccattgtctcgataagcgactacaaacgcacggtcgatactatgagtcgaatccagtctcacgaaggtctggcggagcagagaaaaggagtaaggggtacaagaagaagctggaaaggttcatagtgacccatcccaccgtgagagtctcaagtgaagtcagaaacaagtctcaagatagtgtcaaagccgagttgacccagaacatcagtaccatgtccgggctgaaacaacaacagcagaactacaagaagatcctggacattggatttgtgggaaatgactcgatttaagcctactatttcaatatcggtctcaaaatcaacacctttcagttcgacagaaccgtggctacggcggccatctcgactatcatctaccagaagcactgtcccacggtgtttgtcgatggcgatattcaggtcaattctgacaagaaactgtttgttgttggcgaacatgggaatctcattgatctctcacaatattttaaagtatgtattacttattgcgcaatactgtagctggacatacacgagaagtggatatatatgttcaattgacatggaagaacattcaggtcccagagaaacacttttttcgcgtttcattgcgtggtttggagcttttttgtggttcagacatttggagcataagaaaaaaaccattcatcaatttgaatcggtttaattattttataatgatgtattatgttatcatatagatcaagtgaagttataattaatgaatgtattaggcaaaaaatattaaatgtatatatactgtatatatatatactgtataaatatatatatatatatattgaagattgccaggtcccttggttcgaacgcctccttttagacgaagacgtctgtcagtgagccttccacgggagctcgtatggctctgagggcgacaaactcgagcaccatgtccaatttgacgtcctagcacaggaacaatccttgtatcattcacagtgtgtggaataattcatctgagtcgcgagcaatcgtggacatgacattcttgtggctccccctttccactcgcaaacggacagtacaagtacaggtacgagtccaattcacttggaaaacacgtccattttaatgaaactcaaacccttttaaactcgtgtatgtgaccaatttttgtgttgcaagtgacccccatattaaaaatcaaactcaaactccgttaaactcgtgtaagtgaccaatttttgagttgtaagtgacccattttgtcgaacaaaaaaaacccacatttgcaactggaggaacacagggcaaaaatatatcaacgcgtaaacttgcaggatcgcatattgtatgatttaccaaaaaatacatagcatcccattactgttgaaactcattacaatggaacacaacacatgagcacattcaatttcagcgactatcccgccgagaagaacttcacggcagcacctcatccgcctcttctcccagaatcatctcacagatgatgtggggcccctcaatgggttttcaaaaccccagggggttgcattcaccaccctcataaggcgtcaaagtctggaggccgaaagtccgtgcgacatctgatgcgctgctgttgcgacgggtgagatatctcaacttcttcactaagataatacaggcaaaattcaactacagtatgtacaacccggatggaacaacacacacacgctatcgacggatctgacgtgacctctgatgtctccgaactgggcttgccaatcattctgaagttcatgggcttgtcaacgaagttcagaaggttgtgttggggaaagatccattatactgtcctacttgtagcctgcccaagatgaagtcattcgaaacacttgctgagttggaaaagtacatcgaggacttaggcttgacacaacaaaagcgccgttgatgggaagaacttttactttgggtggtctaggactttcgctgctcgctacgatttgaagtcaatgggagacacagctactcagggtatatcttacgcttgttctatcgaaagccatctgatggcccagagatcggatgccctgtgaaacttcgtgccgccctggactaggagggaatctggcacttgcgtcattgccagtatcagggtgccacaacctgctgagacagagtggaaagggttgggccgtcgtctcaaaagccccgcagggtcttagcgtggagagagtagtatcaaacgaggcattatggaatgaggtgtgatatggtggcagtatcagggtccaactaattctcacaactgtcacatttggggatgaagtggcttctctctcaaacgctatactgacttgatcgaagatttactggtagcaaagaccgttcaaggacaacgatagtttcagagaccattcaacgacagtttcagataccgttcaaggacaatttcagagaccattcaacgacagtttcagagaccattcaacgacagtttcagataccgtctacaatccctaaaatatcaatttgtactcatttaatagcacggtattcgaccagatcgctcacgttcaactcgtttgttaaaccttaatacgtttaaagctcggaaatgtggtaattaaatcatccccttccaacagacaatcacgtacacttcgtgcgggagcacttgtaccttcccaaaatggatgtccaaaatcgtcccgaaactctaatatggtcaccggaaacctaatcgagtaagttgaacatccaccagcgctgtacgcgttcagaaatcgtgaaaacgtgaaaaaatcatttgaaagtgaatatatcaaattaccagacgatagtcatcatctgcaactaagtatgtctcttggggacgtttgagacgtcgcggtcgcccctctcaacatgagacgtgtttcgggaaggctccgggatgcctcttaccgcgtagtattggtgaaaggtgtactctttctggtgtcgcctcaacatgtattatgctctttcttacctcacgtgccgcctgttagagccccatggcagtggtggcagtctggctatctgtagcctgtttgtcggtgatccttgtttcgaaaatgtctacgtaatgaatgcccgaatgtcgaatatgacccgatgattgtactcgtgctgtaccaacctttcccatcacgtgcttcagtcctcacacacgctccggttgtgttcacgtgtcacgttcaaagttacagaaaatggctgtcgggtattccgagcccaggtatcttgccctacgcgggtctcattggaaaactggctatgtattctgactctgtgggttcactcatccatatcgagctcgattcggatgattttgcaatcttcgaaattgcagcagctgattcggcatcatatcactgtagtacatatgtaatgtacatactgtacactcataccgccaaattgtggacttcaggtaggaattgggatcccgctaactgtccgaattagggttgcaggctccggtagctcgattctttttggactgaggttcaaattgctcctcctacagaggccgtcacgagatatactgtagccagaagacgtggttctacatggacaagtatgaagacatcaacaaaaacaccctgaaacctcggcacctactgctatctacacctcccccgttctcaagagacttagacacgccgttgaccatccgcaaccgacgagcctccttgttgctgactgaagattctcaatttcttagcaaccgcgtaaatacgcgtcagaccccggcggcttagctgtggctgttcaactatccccaaattggacacgacgtcaaaaaagaatcgaatatgttgcagcttctgacaattcaggaatttctgtacttttttccatatgagaatgagattgcgacgcgtaatatcccctcaagagattgtcccatctcgcagatttccacagtcgcacaataccgcataaaatacgcacatcatgcataaaaagaaacctaacccaaataacctgttctggatacaagtcgaaatactacataccctaacccttcaatacacataataccctaacccatcaaagtatatactcggaaataaccttatttgacacatactgtagttgcaacataattgcatagattatgcaagtggtggtatcgcgatttcgatattacatttacgtaggtactgtacatgtacttgtaaatctttaatttctatctcaaagcatcccatttttcaacctggccacataactagccagatttgcttgagcccgttcagcctcggctgtggcattcttgtaatcaaccatatacgcctctctcatggcggctgaagcaaccccaatggcagcgatatcctcgttgacaatgccaatgttttgcagcactagggctttctcgccatactcgacccccagctgtcttctcagggtagccattcttgtctctgcggcttggttcagcttctccatttgatgcttcaccgtctggatcttctgttccagctggtcacattcgtgctgcgacctccgggcatctctattcccattctccagttccagcgaagactggtcatagaggtgggagagacgaagatgccggtcgtgaatctcttcgaggttggatttctccgtgtcgaggttctgagacgcagccttgagagcgtccatgtcgattctgaactgtttgagagactggatggagatgtccaacttctgagcccgttgactcagcgtgtcggagagatgctttttgtgggccacctgctggtgcatggcgtctgcatggcttcttagggccactgggtcttgcgaaacggtggtgctgagcgcaaaaatgtctccgttcaacctattgacgagattttgctgctggtccaagcgggaaaccacggcccttagcctgctcttgaagttgtttttctcctccacgagctcaacgttcatgtcagccaatttgttgagttgcgcctttttgtcttcgttgctggccagttcgtcttcgagtgagttttctgccaccagaagtctcagctgtttgagacgctccatttttcgccttctctcctgggttcgtgtctccattctgacattctcttcctccagggactgtttcatgtacagcgcccattcttctcgacactcgcggaaacgagcgtagttgatgaatgccgaaagaagtagcctgagacgcttcgcggtcggatgcagaatgtcgtccatggagaagtcgtgcacgccacagtcctggaacagttggaaaatcggcttttgcactgccaacaacacaaagccgtcgtagagactcgactcgttctgcgtttgggctgcgcactggctgaacgcctcggccacccgttcgagatctgagcccagtagagaggagaccagtcgaatgtagatggtttccaccacctgctgggttggtttcaggagctgatcttccgacaagttgagctcgaagcctgccagaatcgtgatgatctcgtccagatctagaacgggccagcagacgttgaccgcctggggcttttgtttccgaggagtcatgtacatagacattggatagagtggtggacgggaggtggagtggaagattgaaactgcgagggtctggctggtatttgtacgaggtatagatgggcgattttgtttctgaagccatgttgcggcttgtggggttgttttgtgattttataaccgatgaagagcggttgagctgcgttatcgaagagcaattgtgcttgggcggcgccttccactgaccagaagaaagaagaaatcagtgcatcgtctaatgaaacacaacagctatctccagatgttttttttttctcatttttctcattttttctcattttttctctcattttttgtcttcatgggtttgtgcccgtgccttattctccgtgagatggattatgcacatggcgctgaatttactgagcgttttgcgtctttacgaaacgccccatttgagcacgtgacggggacggtgaggagatataatcgcacaagtgtccgtggagagtatcctcgggcgaatgtggctgagtcagagtgaagagtatcttagtcagcacgacaaacgggatcttgtcaggctgtagaggggcatccaggagcgaccgattcgcctgatgagttggaggcaacaatatccgttgtttttccggcttagatcttcttggaccgagcctcatggcattgagagtggggagctggtttcaccaccagtcttgccagcagtctttcggctagccgtttttcggccaccagatgagtctttcggattgtacttcaccaaaaagtcacaattcaggagtgatagtgtccatcaggcgaactttttgttatggacatgattctgcatcatggtctgtatccacaggcttcctcaccaattcacatgagattggtgagaatttttccgagaaaacaagcataaccattgtgcttcaagggctcgtttccttcactttccatcaaatccacgcatgcgtgtgagaagtatggaactcgaagcgacgtcatgggagcaggtggccaagctcaacctcaagaccctgcaactgagagactcattctcattccaagcttacactcaagctcacactcaagctcgccctctagctcgccctcaagctcacacgcagacttacactcaaactccacaatgctcatccaaagttgcggggtcggctattgattttgtctgaggcattatgttctggtgagatgtgtgctgtccgcgttgaagagaccgtgaatccagtttacgagtgacaatggatgatgtcaatgacccagtgagttagatactgaggacacatatttacagtccaactccgcccgctcagtccgctccgtcagctcagtccggtcagttctgctcacccatgctttcacttactctacagttcctccactctaacatggcatcagtctcacatgaccagctccgagataacatggccacgtttcctacaccttggtagatgccaagatgttgctcccccattcctttagctcctagcttcgcttcgctccagcaaacgttcgctcaatgaacgtttcgctcgcaaaaaaagggtcacacctaaagaacagaacacatgcctgcgtgatacaccttttcccatcgtcgaggttaggctgaactgtacacgaacagcaccgagaaatagctacatgtgctctacgtctccatgatgatttcacatctgctctgcaacagctagacacagcctccacgatatcataaaggtgcattatcttggtgcagcccctttttaatattgccaagaccagatctgcctatacaaatacttcaaccgttatttttagctgcatttcgagtttttgaggttgtgccaaagcaggttgattattggacgattggacctcggctcaaatcccgcaacgcacaacaccaaacagagggtaaagataaccctaaaatgtgctcaaaatgccgattatcaacagcttggcactgtttgaagccgttcgaagtccatatcgccttataatgacgtttgttatcgtcgtctcaactgacaggggagttttttggcccagctctcccaactcccagacaggcctctcaaacgtgggagccgggatctttagcatcgtgaaaagtcaactctaagggcccgcagagtgagagaaaactcttccatacctctgcagctcttatcgacccatatatttgcacccgaggtcggagatttggaaacgtccgatggtgcttcgctgtgcagaatgggccgtacatgcgtacaatatgcattttctgtgcatggcaggtgcaacactgaggtagttcggctttcgttataggccgatattcgtggtgtcgtgatagtgttatctcgatcggtgttacagccaagacggctgggtcccgcgctgctttccagcacttgtagaccccaagccactcttggcaagctggaattgttgcgatccacgtgatatttagccatcgtacgggtgtttggttgcgagcgtgtaacaaatgtgttacaaatggacgtgccaatctccccgtgagcctgaagcacgccatcatcgacagctacgaggttgacagctgcaggaactgcagtttacggagcggttgggagctggagttgccagtgactaatgtcgtattgccgatttcgatgcagcccgttgggttcgcttacaaattttacgagccatgcagcgcatcggattgaatagcaaccgtgcgtgccgtcagccgtatggagggggggaggattgaggcgcgcaaagtcaagctgatgcggcgaatcgattcacatgggtgtttgtggattcttggcacgtgttccggtctcgagcagctcgcaattccccatttgtggggtttggagtcgccagtcttgaggcgcttgattcgagaattaatcatagagttttgcgtggcgaattttggctgctggaggagggatattggtcagcagccacctcgcgtgggaagcaagtggagccggcaacacatgtgtcgcccgcagtcattttgctctatgtgggactccccaatttctgtctggtttcttggccatctttcgctctggccgggttttctttttttttttttttttaggtccgctccgtgctggcggaacggaagtttggcggagttagcaggttcctggtgaaaaaaaaaaaaccgagtctatagccgcacagccaaaagaccctaacaaagttgcgagccagagtcatacacgcagcatgcaagtgtgcacacaatgtcccattgtgagtaatcccacagttgttgagcatggaccggcaggggaatcttgtggaggaccggtacgagtgcgattacaagtacaatactgtacagcaccggacagaacaaccaattgtcgccatgaagacgaacgcgaagacagatgacaaagtcaatggaaaagcaaagcccagagctaaaaagagacgagtgtgtcatagagtttggcgatggcaagtccgctgggttcggacaagccaaaattaagtccgtaacctccgatgcagggatcggcatgcaaaacggtgctacaaccattactcacaccggaggtgcatggagatcagacatgtatatatagaccgggaacccctccttttctggggagcaccaaacacaaaccccacagctagcgccgacacatccacaagaccaacacaatgagccccacaaccatctccacagtgcccgagacctcgaccgcggacatctacttcatgtcttctcgagcccgaaacaagttggcccgagagtcatacaagcccgagctcaatctgcgaaagctcgtggcacacgccaatctcatggactcgctctacgacgagctggagtaccgacgatcgcgataccaggtgcaatttgttgagcctgccaagcccatgcgaaaggccccctcggcacccacacccatggaagacattcccgaatacgagtcttcggacgaagagactgagagcgaggaggagagcgaggaggaggacgagcaggacaactactctatgacggtggacaacaacgtgcacatttttggcgagcctgacacagacgttatggcggacgcgacttttgccacccatcacaaggttcaaagctccgataatctcactttcaacgagatgctcctgcagcaataagcattcatcgctgcgtctactaacctctcatccagagccagtgctggcgctggcctcttcgtacatagattatttattgaatgattttttttttcttcacaagtgtcagtgtgtgtcagtgtagtaaaagtattttgtaagatgttattttattttattttattttattttattttattttattttattttattttattggattttattttataggatttaaattttaaattttatttccccgtttttatcttttttgtttcatcgcgtacagtgtacctgtagttaccttatcagatgcattatgtaatccaccaccactcagcccggaatgtgacaggctaaaaaaagaaggtggaaaatggcgtatcgtctgttcttggtgttgcgacgcgttggttccagacacactttccgtcccctcaaatggcgctattcatcgccatcgccatatccttggcaccccgatccagagcaaggacggaaactccgagtaagtttggaatgcagtcctggagaagagaaaaacgagagattgacttcgcaaatcatgtgaaatgagctccaagcctgctgctactaatcggcgatggcagcaagccaagaaagagggtgagtgggtctgtggtgggtccgtagtatcgacacagccctcggacagggataggatatggcgtgggctgtgtttgctgcaccaagactgaatcgtctacacagccattcaattgatcgaacacaaccaactcaattgaacaaacacgaccacctctcttaccgttaaccgtactttttttccctgacacatctgctcgtgtcccttgatcacaggtcacgccccccatagggttggtggagtacataggacaaatggtaatccggtactccggcagtcgtaaactgaaaccgtctgtaatatcctatcagccattgagtttcggctctgagagttgctatgaaatttaatcggtccacgcctaactaggacttgtagacttccgactcatgggatgccggagctcctagggctgctgaaactcgaatacttcagtagcaatgggtcacgttggttgaagccttagatcgggataaattcgctcaatctgcctcgcagtgggacagatctggtcgatccgacagtaatacgacgggaggggcagaagtgagtcgacagagaacctcctcaccagtagaccagtgggtgtaaagtgggtgtaaggactgtgacctttttgcacactgcaaatctaagctctcctcttctgcgctcccatcttttgtggccaatctcttctgtccaagaggtagtccaacttgactccattgaatggatacgccgagtcttcaccaatggtcctcctgtatctgtcctccatgactgcattcatgcatgagatacgaccatctcttcggactcttcccatctttgccaaaatgtctgcccgttcgtttccagggtgaccgcaatgccccacgatatgccggagcatcactttcatgcccagcaactgcttatacagttggatgcttgtcacgatggtgtgatacttgcgtggaaagctcttccctgcgttaagtttctggaccacagcatagcaatcacagtagattgtatacaggagatcgtcatgcctgttatagagtaccttgtacgcctcaagtagacctcgaagctctccttgtaggggatcctggagatcacccgtcaatggtccagccacattgtctggatggtaatggccaaaccataccccaaaaccaccccactgtttcccatcagaatccaccttactggacccgtcactgaatacctcgaagacaggtctgccacgtatgttcaagtgttggcgttgggtggcctcgaagaatttcggtctgctttccaagaaatacgcagcatcttgaagatcgtcaaacctatgaacatcttcgggtctggtggagtggttaagcgcgacattgaagtcagtgaacaccccagggtgcctagaatatttgacggcatagtatgtgcgctgactattaccaggtgaaacatatgcctgaagtgtactttcttccaaggcaggatcatatctgatccttttagggcccctctcttgtggttttgattttttcggctcctctctgggtcgtttcaaagtagaggcacctacaaagataacagagtcagactctgtagagctgagtgagatgacagagtcacagtcggaggcgtcatcatcagaactcaggcagatgacagaatcgtctcctgagctaagagaaatcacagactcagggtaatcgtcatcacttgaatcgatgacacatggtaacgtaggagatggttcaccaggggtgtcgcagtacttgtctacgcgatgctctagagggaatactcgagagcattcctcaagtgatccaaagtcgctcgaacaggtcacatatggtgatgcaggacatggtgtgtcaggagtagcgtacgagtagtagccgttgttgtgatactcgaaaggaacgacttgagagatttgctctagaggttccggcggggagtaccagtctgagttgttagagtcgtgggtatcgtcaatcttgatcagtccagagtgctcggctgttgtcgtcggcatggaatattcggctgctgtgtgtgctgacggagtatggggagtaactgacaataacagtggctgtcgagcctccttttttggggtggtagtgaaagtcaagtcgtttgtcatctcttcgagaatagagctgaatctgcgataaaacaaagccacaggcctaccttggtacatcatcgtcatctcaacaggtttcttgtggatgatcgctgcaggcttctggttgtgagtgactaccaatttcgacaaccaagggtaaggaaatgtggtgatggacacatcaaagtcggtatcgtcgtcgtctgtgtcttcgctatcagccccgtagccgtcgtcttcctggtcaaatgggttgtccaggacatcggaggcgtcgtaccacttgacatctgcgtgccagtcacatgttcgtatcccgtttggttctgagtcactgaataatcctttgccattcatgtcgtgtggggtaaggatggggagttaacgatggtgaggcgtgtggcatacttggtgtgacagacgaggagtgtatggaaaagacaacttgatcttccaatagcttgggactgcattagtaactgttcgaaaatggacaaaatggagtactgtacagccaacgttccgggagcgtaccgcttctcgaccgcgagtactgtacagttcatcaccatcataagaagacaatactcagatcaacactcagatcgatactcggatcaatactcacagatcaaaatcggccgtagaatttgcttacagcgttggttcttgtaccatccagtatccagtttgtggagtctggagtttgcaagttcacaggtcgagttgctcgttgagaaaccaaggctgtcgcaagagtcaggatcagaatcccgggtgaatttgaagtggcacaagtgtgtaggacctgggtcaaaaaggtggtggtttgtgttgatggaatatttcagttctgcgagacatgcatgtttggtgtacagtaggagtagggttcaactaacaagggctggaaaagagttgaaggtataaaaaaagaattaaaaaagaattaaaaaagaattaaaaaagaattaaaaagaattaaaataaaaaaataaaaaaatccggcaaatttcattcggtggcatcgaatcctacaaatgttgaataaaacaaacttttataaaaaaccaacacactagcgacttaataaccagactcttctctctggagagtctttgcatctacaagtagtggaacggctgagcacgcgcgactgagtacgccatcagattcaaattcagctgagtgatttactccataagaatggaaagtacttgtagtgtcgtcacccacatcgaggtttccattcaccctgttatttcagaccttcacatcgcgtccaaaaatttacttccaatgcaaatggagtgtgggagaccttctcaagtaatgcttatcacagtacgtgcagcatatgaagaaaaaaaaaaaaaaaaaaaaaaaaaaaaaaaaaaaaaaaaaaaaaaaaacagagcaaaggagccggcttagaacattctcgtttgaataccattacagatatgtataacatggaattatttgtggttacataatttctttgtatatatctcaacagtattcctcgctcgagactacagtctgttccacttgaaactcttgaaaaagctctgaaaaagctcagaaatgtaaataacaaaacctccaaagcgcaagtgtttggtaaaatgatacaaattgtagactgtgacaaaattgaactagaaagatatatatcagcttatagtctcgtcttcgactgctgagacgtaacaagtaacatactgtgcagtgtacttgtaaggaaggtccaatgcgctacctgtagtatgcgacaaatcgtgggaagaacagcatgatgttcataggatgaataaccggacgtttcttccttggatctcaagtccagatccttctccgctcccagttaccaagatgcttctacaactccttgtccttgccgagaaccacgagtatcggcggttgtacatggatgggactggacttgaagagatcagtccatgctgagattcaaagggacattgaaaataaggtcttttcgaaaggaggaactctctcggggtgctcagctgcgtccgtagaacttcatcgtacgaaggatgtacacatggttggagttctcatgtgagcttggaagagtgggcgggtgaaccgaagaagtcaagagtggtaattgctccgtcgaaagtgaatcaagtctgtcttcatccatgggttcttttgtctatctcagcttttagtttgtttcctgctttagtacagtagcgtcgtagttttcgaccaacaacactcagcagaactacgtagagaaattaccacaatgccttctcagagtatcgaaattagcacaatgtggtgatgataaaattgcaaaataggaccggatttatccatcagaagaatttcaattttttctgtccagtatttatcgcgttatggatttttttatatttttggtctatttattttttatatataattatccattgcagctaatttccccaacaatcccaacagtaattagtgtaagtaattattccgttttttaattatttttttctttcttcttattctttaacgagagaaaaactttcttaaacaaatcttcactttggcagaatttcaaatccaatttccatgagattcgatacagtgaatagataattgaccacacgaagttactcctccgatcatccgctttcaaacaacaccactttcaaccatgtctgctacttcttccgttgttcccattggtggtgaccacctcatcaacagcaccaacgatgatgctcttgacgggaaatcggacccccctggagataagaaacccaagggctaaatttatgcgtcggaagatatcaaaatcaaccctctcgcttattccctcgtccccgaggatgggcataatgccaccaacgatgctgttgggtactacacctatctcaaagaagctctcgcggctaaagccaagatccccagtgccgacacgggaaaaacccgacgaaatgtctgtgatgccctaaaggaggaaggagtggttgtctaaaccaacacccactgccgctcccgccgaagagtggcgccgctccgagccttctacttctttcgggctcccgatggaattcgttgtcttctgggggacagaaagcagctgtcctacctggagcgaggttggttccagagctttattgacgagttcgctcgatagtctccccaagcccggatcaataagcatcccataatttcatcacgctaacctcaagtgcgcctacatggtggcggaaatcaacttcctcgctgataaccagcatctacgtgatgtccatttcaacgtaaatcccctgttcgcccccccgggccccatgggagctatcattgcccattttgccatgggagactgcgtctgcttcaattgcctgcacaacaggcatttgagaaaccagtgcgacccagcgattctccgaccccctcgggacctcaaagtgatcccccacgtgtacgacaagctcatgggcaaggagatacctgaagacccgtcttgggctattgccaaccccctgtctgagcccgtcatgcccgagtggtggataaacgctctgaaggccagggaagaggagaagaaggcagaggccgaggttaggtcaaaggtcgaggccgagaacaaggccagacaagaggagaagtcagctaatgaatcccgtgctaatacaggccggggtagacacggcaccagccgtggctttaccatgggtcacctggtgcctcacgacccgtgttgggctattgccaaccccctttctgctgcagtcacccaccactgggagacagaggctctgaaggccagggaagacaaggccaaggccaagtccagacaagatgcgaactcagtcgaataatcttgtgctgaggctgacggagttagaaacggctccctgcaggccccagccatggctttaccatgaatatatatctgagtcatggtaccattgaccgccaccagattatcaacaggtgactcacaagcactcagcgaaggagactcgaaacgaaaacttcacaatcaagggtaaaaaaaaaaaaaaaacttcaacggaaacaggtttggggacatctttatagaggagaggttggatggtgtgaactctctcgcaaacttttcggcagggggctcagtgacgcacatctccaagactcgtctggttcggacacacaactctcgatcctcgcatctaaagggctccaagcccaagtcaagatactaaagaagtacgagtcccccaccaagtcttccatcgttccggagatcccgtcgtctgatcttcaccaagaaaggagacgatatccgaaacctggtaacatcccctctcaactatttctggtaccagagtccaatgggggacatggatatgtctatcgccgttaccccgtccgatcctgctcccgctcctgttcccgttcccccacccgttgttcccaacacccagtcccagcaggatccccagccgaaaccgccacatgtgtatgcagaagatggcgataaagtagtgtccaacactgaaagtcctccggtggaatgtcggttccctctgcaatcccctttagtgtcatttgacaggacacaaacaacagacatcagatatcctactccttcaggagacgaatgttgagtcttggtcacccagctgaacagtgttgccctggccatatgttcttcggctcggaagaggccaattttgagggacgggctgatcatatctgaccggatacatctcttacagtgcacgaccacctttgatggattccccagtctaaacccacggctcctacgagctgacatccaaatcaagggcaccggtgttgcttcgactcttctccgccgcgtccatgccccggtggagcagagcgacaacaaccacgcgacagcataaaggggagtcgtgacgtcttctagtaagatcccacgtggcgaagcgagaagttttactcagatctgtgcggtttttggatcgagatcctcctgggtacgatataatggcagactggaatctcatggcagactggaatgccattgcagttcccaagatcgacgaacaagctctccctttcaacactacgagggtgtctcgacctctctttgatgtctatacacacctggttgaaagaggaaaacctccaaactacactcacacaaacagaggccccggacattccaaaagtgactacacattatgcagacctctcgattttgtgttcgtgtgtaaacgtctcctcgagtttcttccacccatgaactcctgcaacaccaggataggtcctcccacttcccagtgtagagctccttcaagtttcagtcccagcatggagagaatctcaatacatctatttttcagagtatcttccccggcttacaaagatagttgacaatgcttttgccctgagagaacctctacttacggagctccggttgctttctattgttgagacgattcagtctcaaattcagtcggactccaaaaggagggctatttgtctccgggacgaatgaagagacaacctcgaacgtcttcaggagattcaggatgaggcactgaaggctcggttaccttttgacgaccacgtgcctgccaatgaaagcggtagtcaagacctgcgtcaagagcaccaacattatatcccttcgagggcctgatgacacctttttctcagacacacattagcctgagctctccttcacagacatttacaagcacaaaggcaaccccgagggcttcgaagagtttttgaaagagatacccaaagtttctacataccaaggtcggttcttgatcagatgatgaaagaggacattcaacgggcccctttacggaggaacagctatgagataccctcaagacctgccctcacctacaagctctatgctaagttttttgaccagttcaaggacctcctttttggggtctctgaagccagcccgtgtcccgacaacgaaacactttggtgatccgcctgcttctaaaggatggtgaccccatcgatgtcgtcaactaccgccccatctcgttgatcgagctgaagatcttctcttcattcacattgttagcctcgtatgcagaaaaccctgaactccacccagcacaggccggttttgttctttcctggtaggcagatgactaccaacctcgatgcgattgagcactacagtacatactacaatgtgtatggcaagagagtctcggatgcttgacatgctcgacttcaagaaggcctatgactcaatcagccaacaatggatcagaatggtattagcttccatctgatattttgtatcacctgcactaacttaaggccacccagtttctgagaaggcattacaggtgtgatgatagaagcgctgcaactctacgcaagctgcggctgagtcaactccccttcactcggaggtaccccaaatcggaatatcggaatatgtccgttacagagacatctgatgtagttcttgccaactctcaaacaaaaggactacctccacgagcatctttttgtcaactgtctagcgtccaaggccatttccagaagactgtgtccgatccaagatgacggactggatcttattggagaaggacgacccattgaactacattcgggagctcgcccatgcctcgtggcaattttgagcgagccatgcgcagagctgacctacttgtaatgggtactgactctgaggtcccgcgagatctcgctcacttgttcgcccgagtgtccgcagcatagcgtgacggaaggcggatacgcggtggcgaacaagcgccaggcgtcatcatcactctaggaggattatcacaatggctgtgaagtctactcgcgctaaagaaacacgctaccagcaatgattaaaaacacctccatatatatttattctaacatagttttttaccattacagctatatatccagtattcgggttaatggcgttcagtacatacatgataaatatttcggtatgcgctgcgcttttttttattattctaatggttcagtttttttttgttcttttttgttcttttttttttgttcttttttgttcttttttttttattctaatggttttttttttattctaatggttttttttttattctaatgattcatggctgtccttgccaaaattcaaaatgggtacaaagttcacttttttataacatacttcgcgcggatttagctcagttgggagagcgccagactgaagtagttctcagtcttgaaatctggaggtcctgtgttcgatccacagaattcgcaattgcaacttttttttgcagctcctcactcttgttctctcctagttcaaatacaccgaccttccaaccttctcccctcaccatatacccttgtatatgccgtgactccacctaccctgctacactgcactgtctacaaaaaacatacccctgcgcacaatggagacaggtgcaacttgatggctctgcaaacaatacctataagtagggcttggtatctatttttgggcctggtcctctatcgatattggtgcaaccatgaagctctccaccctgctcgctcaagcctcagtggttctggccattggctacaagtctcaccagtacaactccaacgttccctatgctgtgggatacgcggccctgactgacgagggcttctgcaagactgaacagcgaatctgggaagatttggaagatatccatgagcagggcgtcaaggcggtggccattgaaggcgtgacttgcgaccaacaccaacatgtggtccgactggcttacgggctgggactcaaggtgcacgtttcgtttcccgtcaccagaagcggcctcgagtcggcgtctctgcaaatgagagtctttgtggactcgttcaacttgtcgccccactggaacgctgtggaggcggtggtggtgggcaattctgccatcaaaaacgaccacgccggctggatggatctcgaaaacctcacgtggaacctcaaggcggctctcaagaatgcgggctacggtggactcatcagtatcgccgagcctgccgaaacgtttgagaactttcctctgctgtgcaggtcggacacgatcgactttgtctccgtcgaggtctggccctactaccatccccagtacgcccatcgagactctggtctgctggtggcccgggaaatcttgagagccgaacgagcctgcgctttcaagtctgtgtttgtcacctccgcaggctacccttcttctggaatcaccaacggcaaccaaattgcgtccagagatcgacaggagcaggccgtcaacctgatgctggcccagactcggggaaacatcacgctgcagacgtacttcaacgagccctggagagaagagggtcagttcaaggacctccagtactacggaatgcgtaaggtgattcagggaggctatgattaaatcgcagactgctatgtgggtatctaacacttttctattcatcaatcctattaatatgtttcaacggtacaagtactgtaccgttacacgtacatgtgtactcacttgaacttgtacacccttgctctacccttgctctaccctcttctactagtactttctacatttcagcttgtgtcgattagttgtatacaggaacgacttgatcagttcgcaacaactccaatatttgacagtccatcatactactgtatgtacagtatgtacttgtagttgtccaaatactaatacagtgatgtacttctacagtacattccttccatggtctctgttcagatgatgttttatacactataaataacatgttgtcagtctctcgctgtctacttttggtcgctgttctgttctccccctctgagaggcttgacgatacgagcagcggcatccaaaagacctgtgctcagccgcttggagttggaaacctccatattcaactcgtcttcaaatgaaagcgagctgcgatggtcgccctcaagcacctgttggggcagctgcagaggccgcacctgtctattggaggtgctcttgacacgcaccatgcgttcacgtagggtggtcagtttcagctggaacgactcggtttccttttccagcgactgccgtgagtccgccaacagctgctccagcgtctcgattcgctcgttacgcatgctcagcagccgtttgctcacctctacgtccttcttgagcgcgttgttctgctcaatgatctcccgctgcacgtgagtcagcttttcgaggttgcgttccagtagcgccatcttcttggtcttggcggagttgtgctggtccttgatctggtccaggttgatttccaactccacaattcgctcgcagcgcgtctgaatgtcccgaaccagatcctcctcacgggacttgacggtggtcacgtcctggcgcagcatagagttctccttgagaagcgtcgaaatctggtccgacagctggtccagagagtcgggagtcacctcagtgttttccaggcgctgcagagtctctttgagagctgccagactcttgttgacaccctgcgaagcggcactttcgcccagagtaccattgctgatgcccgagtggttgatattgtcattgtcgtcgagaaagccgccaaaaagatccggattggtcttctttgtcatcttcttgagcgaactgacctcgtccttgagcacgtccacgctcacttgctgctctttcttctcgtgcagcgcccgttctagcgtctccttgagcttgatggtctcattgtcactctcagttcgtcgagtcagctcagactgcagctcagacaatagcttgtcctgctcagaaatgactgtttccttctccaccagctggtcctgcaactcgttttctcgccgcagatactcatcaatcatgtccgagtcaagcacagtggaagaccgtcgagagagcagctggtcaatgggagtgctggcgcgtctattgaacgagagccggttcgacggagttagaggagtgccaggacgcgaacttctgagcgaaacgatcgagtcccgattgttagaagtgggcgtttctctctcgctactcgtagacgccttatccttggcccactgcgattttggcacgttttcgccctttctccactgtgccacctcctcctccagacgcgtaatgtagctgttttggccatcgattttgacctggcactttttgagaatcctgcgcagctcaatggtgctgagctcggcgttgatcttggcccggttcttgatacttttggcccgcactccaaaccgcagcgtggaaatcgtctccgcctcgttgaaagaggtcggcgagcagttgatgatcagcgacgtgcgcgaattgccgcccagagactcctgtagaattcgcgtcagcttggaatctcgatagggtatatgagtgcttccgtccgtcagagagttgatcaccagacccagcgcactgagcgacttgttgatctttttggcctcctcgagcgtctggcccgaagcgccggtcttgcccaccttttctgagcccgcaagatccaccagaaacagctgaccggttttctgggcgccagaagccacgtttttctgcgaaacggcaatggaaaaaatgctatgcgaccgcgatgactcctggttcatgttggtggcggccacggcccgcgataacgagccctgccgcatcaccgcatgcacctctgcggcattactgacgtattcctcactgagacccttgacaaagacgcccctggccttgtcctcgtgaatcggcagattgtcgtgttccggatgcagcagatcgcgaatcttctccatgtaaatttccatgtacgacaccttgaccatgtactcaatgtcctgggaactggcgaagatctgctcaaagatctggtccaccatgcgcggtatcgctccccgtcgctcggcatggtcaatgtctcccatcatggtgtacgtcttgccgctgcccgtctgtccatatgcaaataccgttccgttgtagccgttgagcaggtcgtccaccgtttccttcaagcagtactcaaacacgtctgcctgctgcgacgtcgagtcgaacacccggtcgaacgtgaacgacgtggacgtcgagtccttggtcgcaacgtgacacgtgtcgttgccgtcgaacgacacaatgttttcgtcttcattgtcgtcgggccggaatcgagcaatgaccttgacgttggttgacatgttggccaactggtgatgtgtgtgaagaaccgcggggtaaagtgagaggtccgccgagcgtgttgtgcaaaagaagagaggcgacccgcgcgcgttttagtcaacagagatctccaactgtccaactatcgagctaagtccaaacccacgtcagccgtctaggttcaggggggaggttagggtatgcggtttgattagatccagtgtggtggaaatgtcgctgcgaggaatgtacatgcaagtacgccggaaccatgcgtcttttaggcgcacagtccggggtcacgtgatgcagaggccaggcggtccccgtggcttcatctccgatgagaacgttttctagaccgtctatttgcagtgtagtatctccagcgacaagtacaactgtacctgtagagaggtctaccatgtcctagtctgtttgttgtctttttgaaagcagactaattacttttactactgtacttggtccagtatgtactgtaggtttgggctatcgtgaatgtgaatggtgcgattgttgatggttgtatatacaactgttgatcgaatgtattgtacagtacaagtgcttgtaccgtagcgtttttcggcaactattcggctcgactctcgtacagcactcgcacttgtacttccaattctattgtcggtttgcatttacatgctgtcatgcattgtcgcgtgatcaatagcttcatgagacggagtatcattcggtcctcggcgtaaagtgtccctgtgagtctccgttctcacaccgttcgtgtcgccgttttcacaccgtctgtgtgccgcctatgcgcccttcaacttataagtcatgcccttgagcttgtgcaaatcactggagctctcgctgatccagtggcgaatcaccatggtggtgaaacaggtaaacgctggaatcacccacagatagtcgtagccgacccacggcgcgtgcttgagatacgcctgcaccaggatcagaaccgccagcacagacgccatgggcagcaggtactttttgggagccttgtcgtccaccttgaccttgtaggtgatgtacgcacataccagcaacaccgtcaatgacatgtacgccagcggcttgttgccgtgattgtgacaatagggcagcacaatgaaaatgggcgtttccagacacgccagcgccgcaaacgcaaaccgaaactgctcgttgctgttggccatgtccatttccatcgacttgagcagctccagttgctcttgttcgtctagcggcgccgtgactccgtcgtccacgtcatctggtcggtccagcagtcgttttgtcgctgctctcagtcgtgacatttgtgtgaggagatcgaggagatcgaggagcgagatcgaggtgagatcaaggtgagatcaaggatgaactttatgcaaccagcagtgataaaaaaattaaaaaaaaattaaaaaaaatgcaaccaaggcgctacggaaatcagaggtcacgtgacttccattttcctcggaaggggggggaggggagtacgtctactgttttgcagtgactttttcaatcctcggtgttctcaaaggctcgttctatggctgtttctacagtcttgactatggaacttttgtgaactaaatttggtgcttgttcaactgttatactttagattttgtgagtctaccagaaccggtgttttgcgaggcgagaattatctcgagttcctatcagtgaaacacagtgtttcatggacgtcgatgataagatactgatagataacgatagataccgatagacgccggtagatatcgataaaatagatgaacgagtattcccggttgaaatgatgaccaattgttcatcaagaaggcattggaggaaaccctacactggaagtctggtctctgtcgttttccccagcagctgtcagtcacatcgtgctcttctctgagaaggaggtacttgtagacagaaccactctttctacaaagattacaccaagcacatgtcatgagccgactatagaccttcaaacgctttgcacttgagtgcaacactgtacttggagatgtaggtacagtacctactctgtctgacactcttggtcagctttccagacaactgtctgagatggtgatcgactatcatgaacgacctctagtctaggaggtaacgtctctatttctctacgagaaaacatatatacacaggtttggagggaccatccactaacgttgagacggttcattcaagcgagagtctcaggtgaaaactgattgtgcgaatggttctgggtttaaaaggagttgatacttgcttatattgagataccgacgttgtttttctcgacttgtggacttttcgctgaactctctcgatcagacctggggattacgacagtacagtaaattatcaactagaatccaactaataatctagtccttttcacactaataacggatctaaaaacatatattgttttgaaaactgagcatttattgaaacaagttccattccctatgttcttctcatctcctcgtatacctttcaaggagtcagatatgctggaacaccgaaaatgaacccccagcggaatttcaccctcaactatttctcaactaaacttaccgttacctagagcctccaaagtgtaggcatgggagagtgagatcacgctactacaatgtagtctccactgtgactgaaaacacgagatcattcagaagtcttgcctctaacaaaatactccggttaattgtgcttctcttaaccgccttgtattgtatgcccaacttttccaaaactagaatctacgcagaggaacgactcatagtcacggttgtgctcaagcgccctcaactgctctattcataacatgttaatatctaatacaacttgagctcgtaaatgacaaacggctcgtagtcctgatcggccagaccaccaaattcgcccagaccctggtcgctcttgatcttgccggccttgtccttggcaaaggcgtttcctcccaggtatccaaacttttccaccagtgcgtccttggcctttttgatgttggtgggctcaaaggtggctgtgagaaagttggggggaagaccgtatcgcagcacggactcgacgaaaatgcgaataacccgcaggtgcacaatggccttgaagagatctgcgtaagccgttcgagccagtctcaccacctcgccccacagctggcgctcctgctggctggcctgctgctgctcctggcgctcctcctgcacccgctgcggagagtactcaaagtcccgcactgtgtactttgcctctcggcacttgtggataaactcgggcacaaacttcttgaacagtgtgacgccaaacagggtatactcgtcgtccttggagatgacgtgggccgaccgcggcaccaccatcttggtcagcgactcgtaggagcccacaaactccttggactgcgagttgggcaccgccacgagcaccgtctgcagatgctccgagtcgagcacaaagtcgtcagcggcaacaacgtcgtgcagcgacttgatggacagattgccgctctgcttacggtccaccgaggccagggtgctcttggcgttctggtagttttggaacagggtccgcacgtcctgatctagagacagcgcctcgccagtgatgttgttgctgagctcggtcagaggcacgccctcggtcttgtacttgttggagttccatcggaagtctcgcacgtagtccacctccgaccggtcgttgatctttttggaaaacgcctgctgtgcgggcgagccctcatgcagcactccgatgatgtcagccaccttggccagcgctccgtcgagctggccgtccgtcttgtgaagctcctcggacagctgcaccagcgactccagagtgccaatcttgaactgcggcagatgcagctgcgaagccgggcccaccagagacaagtgctcctgtagccacagctccagctgggtctgagggtcgccgcccgaggttgcgttttggggtagcgaaagctgcaatagaggcatgctggcgtgtgtcttgttgtttttgttgcacggttgtgtcgagtcgagtcgggggtcgtcaattgactgcgtaaagtcggctgcagacctgtgtggcgcttgttagtggtcctggaagctcgtcgtcaccctggctgttaatgtgttgtctggctgtatcgtcatgtcgtcgacaatgcacttgctcggccgggtaactgagtgtaatatatcgagggggggttggactcgaactggagaagacaacatgggagctgttcaaggcggctaccgcgggccgcaagtcgcttatatatctcttgtttctgtttacttggtaaaatcggactttctcaagctgcttaataatcactttggtgcgactacaccacttctacgattaccatatcaccctacaggaaaaaggcaccatacaggaaaaaggcaccatacaggaaaaatacagaaatcctaccccatacaactggacttgctcgagagccgatgaaacaaaaaaagtactcggaaaacaggttggatgtgacacagaccgcggcgcgccaaaaacccgtggattttcgaccgccatcggtccatttctgccatcattgacatctttcagttgaccttccgtccgggtaacccccctcggtcccgggaaggttcgtcagctcccattttcggtggcagttgtcgtcaccaccaaagtcgcacaccacacatcacactcaacgtaagtaatcagcccgtggacaccatgagccacctgccccatgtttgagcgcgtccttgcacggcccctttcatgccccgatggccgctcggcgacgatggacatgtgggtacagatagttgttgagacacaaaaacacacacgacgacgacaccagcctccgagctgaatccatcggcaaaaacacgtttgccctgcggcttttgacggcctacacgagctggcacgtggatttgcggcggaaaccggactgcgcctctcgttaccatgattatgatgcaatgatcatgttagaaagacaacgtcgtgggatcatcggctgttgattcgacaaatctcgacgacagttgaatcataggacgggtggattctctgcagctgtggaactgcaacggctgaatcagaatcagctgaatcgaaccattgttacggaccatgtttgtcgcgtctgacgtctcctaggaccttgaatggtcgttttagttggagcggggttcgcccgccaccttgctcctctttcaacccactacgccgtctgtgttattgtatcttgcttcacctctttgtaccctctccaccatgccaccccccaccaagatccatcaggactaaccccagaatgtcccacgaaggcgaagaagaactcctcgactactccgatagcgaagaaatcgctctcccctccaccaccgtggagtctggctccaacggcgatgccaaggccgagaccaccaccgtcaaggaggagaacaccgagcagaagggctcctacgtcggaatccactccaccggtttccgagacttcttgctcaagcccgagctcctgcgagccattgtcgactgtggtttcgagcatccctctgagggtaagtattaccaacaacaagattaaaccacaaacgccacattgttctttctaacacagtccagcaagtgtgtatcccccagtccattcttggaactgacgttctctgtcaggccaaggccggtgtgggtaagaccgccgttttcgttctctccaccctgcagcagctggagcccgtgcccggcgagtgctccgttgtcgttctgtgtcacacccgagagctggcctaccagatcatgaacgagtacgcccgattctccaagtacctgcccgacgtcaagaccgccgtcttctatggaggttcccccatccagaaggacattgagctgatccagaacaaggagacctccccccacgtcattgtcgctacccccggccgactgcacgccctggtccgagacaagcacctgcgactcggcaacgtcaagacctttgtcatcgatgagtgtgacaaggtcctcgaccagattgatatgcgacgagatgtccaggagattttccgagtgaccccccgacagaagcaggtgatgatgttttccgccaccctgtcccaggagatccgacccatctgcaagaagttcatgtcttctcctctggagattcttgtggacgacgaaggaaagctgaccctgcacggtctccagcagtactatgtcgacgttgaggagaagtccaagaaccgaaagctcggcgacctgctcgacaacctcgagttcaaccaggttatcatcttcgtcaagtctacctctcgagctaacggcctgtctcaggtcctcaatgctaacggattcccctgtaccgcggtgcactctggtattccccaggaggagcgaattgcccgatacaaggagttcaaggagttcaagaagcgaatctgtgtctccaccgatgtctttggtcgaggtattgatatcgagcgaatcaacctggctatcaactacgatctccccgctgaggctgaccagtacctccatcgagtcggtcgagctggtcgattcggaaccaagggtctggccatctcttttgtctccacccctgaggacaaggaggttcttgctaagatccaggagcgattcgaggttaacatcgctccctaccctgctgagggtgttgatccctccacctacatgaactcttaagtgggttcttgtttgttggtactgtataattagtaaaatcttggtgtaatgtttgtgtttactttagtgtacgtgatggacagaggtaatagaagcaatctttgatggactgttatggtccttaacgtaccagttgcggtcctcgaactacatgtacgtagaaactgttccactgaccggttcagaatgttcaccggccgggacgtgaaatgaattgagatggcattgtacactctttttgacctcctatgatggcgttactctcggctttggacattgtgattcgtacgctatgctatgttcgttggagatgtttgaatagaccccggattggtcttgatggtctgttatggtgctgtagcgtacactcgtacgtgtttgctcgatttgatggcaagttgggggcttggtgatcatattctcgcacattcttgcctcagaagcgccctttggaggttggaatgtcgctggggatccgtgtctccgattgcaagaggtgaagatcgttttcagccaagccagggtctgggtgcgtgacaatgtccattgtgggcggagatgggcaacgaggtgtaatattgagagttgcttcttctggtgtcgacagagtacagtgtgtgtttgtatgttggttgtaccagtgtacattgttgatctacggagagactcggtacaagtggatgtacacttgcaattcgtagcacgtgggcaactataccaaccagttgatgggtgggcttgggcgttcaatagcgtccattctgatgccagagccatgtctcgacagatacattctaggatctacgcctagacaagccgctggctcgtattttcatacccggcatcaatgtgccatgttatgagcccatggtgacgcgatggaggatctccattaattggcgcgcctgtttgttccggtctgacgacgcgttctggcgccgtgtctggtgtatgaaagatcgtcggctgcaccgaagagaagatgatcgacacaacacgaggcgaatctccccattttgtcccgactttgggagaggtaaaattagacgacgcaagggatgcctccatctcgcagcggaggcgccgacgaaaaaaatgcagccacttactactgcccattccaccgagagatcatcaccaaggccttggcataggaggtggtgagggggaagacatggcgacgggcgtgcatcatgccaagcgttgagcggagacgacaaggacgcccgagtgaggtttacgccatgtgatagtgtcttgtactggtacattgtggctagggagggcttttgctgtgggcatcgtgatccataccatgtacggtgccgtgtcttgtatagttgagggcaaagacgcggtgaaacagtggtgataaacggccaaacagcttgtaaaacactcgttcgcgcgctcgtcggttcgtccgctcaattctccccattcgcttcagcatcacgcgtcgatacatgcgcctgtctgcatcgacggacccctgcctacactgtacagtgtgggaggaaaaagaaacgagtgtacccttgcaccacgtctcggagccggcgactgcgtttgcaactggtgctggtctcactcgggctgttttgaactttgctcggcccgttgtggcaataacaacaatgttcagtccactcagggaccaggcactcaggcacggcgcatgttttgcaggggtcagcgggtgtacatggtgaaagatggtggaagggttgaatggccgaacagtctgagtgggctgaatggctgaatggctggatggttggatggctgaaccaactggaaggagtcgaatggtgtgtctgtaacacttggcctataccaactcaccgatactcatgctgaattaccgttggtccctacatagtggagtgtaccttagacaaactaaacgagactcgtatagtacaagtacagtacagtaccttgcataacggactaaataatatcccacatatcgcgtaatcagggtctatcgacaggtgtaccagtacttgtaccgtacggtcgccaaccacggttcttactaagccgaattgcacgttccgacacgccatgcagaccgattcgaatgtggatatctacgcccaccaacttgactgtcagacgactccgcgcgacgactcagcgcgacgactcagcgcgacgactctgcccgacagcgacatcttccacatcttccacgtgactgccagacaaatgtgctcttctgttcgtacacttccgctcgtacacttccgctcgtacacttccgctcgtacacttccgctcgtacactcacttgtagacgtccagtcacggtcaaacgctaacccaagcctattgcaaagactaaccctgtgcgagaaaatgcgcacatccatttctcacgccgatctctcccaacagggacaacaagaggtgcgacccaccacctgggcagccatggttgctactttgagggatctgcgagcttgtggctagattgggtggcggtaccatgccgcagaggctggagaatgtgggcaatggtcatagcaagtggtcatgattgacctggggtggtgggcacccaaagacgatagctcaccggtagtggtacctgccagtcgcacctgccagtcgcaccagtcgcgcctgtccactagcatgccccttaatgcagcgacacgcacggtccacggcaaacactatgggtgcgaacgcgaagagtcgcgaaaagagactctgccaacccacttttacgctccaaacagccttttaccgcacttctcacacgcacactcgctcccattgtcaacaggctttgggagcccgacccctgtcaggtgcaagcagcagtgaaagtggtgtgtgaatgcacgaccggtggacttgtccatgacactacatgtatgatacgagatatcttcaaacccaccaccaccagcaaggacaaggacccggtgtcaagtccgtagcacgatacccagtcgtcagacgacgagtaccccactcgacacattccccagtcggtcgatcgagccctggaatgtaaatcatgaggatcgacggtcgagatcgccattgcgcctaaaagacgaggacatggtgaaccgtgtgtgcgtgtgcgtgtgtgttaggcgggaaaaaacaggccagccagagagaggctccaaacgcataaatacccgggtccgcacccctcagttttcctttcctcaacagtcacactcgttcacttcgaccaccactttcattcatatccaactacagtcgaacaatgaagttctctgccattgccatcgctgccgcagccagcatcgtcgtcgccgaccccatcttccttggaaagcccgccgctggaggagttgaccccaacaccttctggttctctcagtcccagacccccacccccgctcctcctcctcctgcccccaccacccaggctcctcctccccctcctgcccccacctcttcccaggctgcccaggagacctgtatcgctcccgcctctaccaacgagaagcgatctcttgctctgatctcccaggtcttctgcaccaagaagtgcttcaagctctccttcggtcttaacacctgtcagggtctcaagtcctgcgagtgtcagttccttgacggcttcgcctggacccagaagtgtctgtcctgttctcaggcttacccccagtacggtatgcaggagattgaggatgtcatcaagaagtgccacccccaggaggccacctctaccattgctcctccccccgttattgtcaccaccactccccccgatgtcaccacttctctgcccgagtgtgaggttccccctcccacctgtacccccgagccttactaccactcttccctcgataacatgctcaacaagcgattcgatatcattggtaagctcacctgcaagaagacctgtaacaccgttgttggcgaccttaactcctgtggtgaggatgccaagtgcatctgcgacaagatcaaggctaccaagtctgccgttgaccagtgtacctcttgtgtccagcagtacaacatgtggccttacttcaacgtcgacaaccagctgctccgatacgtcgaggcttgccaggctgttgccacccccactgccacccccactcccatcatccccgtctgccccacctccggtgtgtcttccgaggctgtcccctcctccactgttgccgctccttcttcttctccttcttcttccgctcccgcttcttctgctgaggagacttccaagactgagtccaagaccgagtccaaggcttcttccaccgaggcttcttcttctgctccctctcccgcccccaccaacggcaccgtctcttcttccaccgcttcttacactaccaagactctgacttccactgtcccttgccacgagtgtgagcacggcggaaacaagactgtcatcgtcaccgtcaccgaggagtgctccaccgagctgccctctaccaccgaggctcccgttgctgacaccacctccgctcctctgaccaccaagacctctgtcgttaacggcaagaccatcactgtcaccgagccctgcgaggagtgcgagcacaagaccgcctctccttctctgaccaccaagaccaccgtcattggcgacaagaccgttaccatcaccgaggagtgctccaccgaggaggccaccgctgcccccacctcttctgttcctacctccgaggcccccgctgctgagtctactgcccccgtcaccaccaaggtcactgttgtcaacggcaagaccgtcaccgtcactgaggagtgcgaggagtgcgagcacaagaagaccgagcaccccgaggctgctccttcttccaccgcctctctgaccacctacaccaccgttgttgagggtgtcaccaagaccatcaccgaggagtgctccaccgaggtccccgccactgaggcccccaagcccacttccgaggcccctgcttccgagacccccgcttctgagggccccaagcctacttccgaggctcccgctgcttcccccgctccttctgcttccgtcgagctcaccaccaaggtcaccatcgttgagggtatcaccaagactctgaccgaggcttccaccattgcccccgctccttctggtgagtccaagcccgagcccaagcccgagtcccccgagggtaagcccgctccttccggacctgcttccggccctgctcctgctccctctggacctgcttccggccccgctccctctggacctgcttccggccccgctccctctggacctgcttccggccccgctccctctggacccgctgctggacccgctccttctggacccgcttccggccccgctccttctggacctgctgccagccctgctccttccggacccgctgctgttccccaggctcctgagcaggctcctgagcagtctgtccccgcccaggccaacggcgctgtcaccaacggtgtctccgctgctgtcctcgccgctgctggtctccttgctcttttctaaattagttgattgccaactgatttgatgagatgccagagatacccctacagctggcatcttagagagagactaactataatacaataatgatgtgaagtaattcttaaccagtagtctgtagtgcctacagctgtggcagtagccatttatttgggacaactctttccaaacaccttgctctcttttactcgtataagggcctcctctcgctgcattccagaacgccgatcgcgccgatcacctcatttgttttgactgctgatcgacacacgacggaatggtctgttctcgtcacctgagagcgacgtacacgtcctatgcgagtcgagacagcaatggtagatgaagatctcatcggaatggatgttcttgacatttgagaggcattgccaattggacgtgtacggtggggggccaagacttgagaggttttgcgagatgagaatggatacgcatgcaaaagggcaaggccgagggcagtgggcgcaaaaggcgccagttacccatacgcaacacttgcaccatattacctgcttctattacttagttagaccagctccacatggttatgtttcacttgctctatgactttcatgttggagatcgacataattgccatttgtgggcgtgaccggggtggtttcttggcgtgtggaccacaaagacgtgtctgtacgcgcactgtatggcattgtctgatatgtccatcatcattgattcgttgctttctgttttgaatggtcttccacggttttcagtgtcctactgcgacgactcaagcttaggctcagacattgtcgcagcgatggttagaggaaggcagaaggcgtctatttgacgcccattctccaacatttgcttggggtttgcagctgacagcttgctgaccctctggcgcagaaagtcgcagtactccatgagtttgtggttgagagaagactcgccctccagcttgccctctatcgactggctgtgcagcttggccacatgttgcagcttctgaggccggtcactgtattcttgcagattcagaagatagttgttgagcctcctcaaatcgtcctgtgtgtagaatgtcttgcatgcctcaaactggctcttcaagtcggccaagtcgcccgaatcgaacccctctctcctcattatgctcagaaacgcgtttcggacgaccaaagatatcaatctgggcgtgttcctggcaatggagtccttcaacttatgagaaacaaccaccccgttgtcctctgataaccgcacatagtgctgacccagagcgcccaggcgccccaaacactccacaatcacttttagaggcagcgagcccatgtttctgtgcagatccttgtccacatacatcttcactatcaaacaacaggtgttcaaatgcacccggttcatgtctcccctgatgctggccatgtagaggggtaacatgggggctatccttgtccgataggacgagtcctgagtctcaaagtagctcgccgcattctgctccacgatccaccccagtggctccgcggtaaatgcttccatggtatctcttctggtatccaaagtggttgtggtgcactttcggaaatgatccaaaatcccttcatcaccctttttttttggccgaacctaacccttaatatcatctgtgcatgaccacatttttcagaaaatcaagaaaaaatccgcaatagtttagtggctagaatttccgcctgtcagaacaatgttcagcacgcgggggaccggagttcaattctccgttgcggagtatctttttgctgctctgttggggtctcttttgctgcacgttggtggtgtatttttgtctccttttttctttctgcaaaccttttggttatctacagattccagctaaatctacttaggccggaagaagatacttgaattaatgaaggtgaaagccgttgcgaagtgatatggtactagatgatcggccggaacatcagaccgaagattggttacactcggattcttgtgaaagctcacgtagtcaggacgtcggatccccttgcgcgggactgggaaatggaacatccatggttcccagacaagatagtacttgccatgcgggattttgctcgggtaatccacatctaagacgtgtcagcggccttgaaaacccgacgggactctggcatctgagtgtataaaaaaatccgcacttgtgaagatggggtggtgtccccagatcacggtatgggtcttgtcggtggtggtcttgtcggtggtggtcttgtcgatgcaacgccatgtcacattgtagagacagaatgaagcacacaaagtcacagtctcaacggaaattgccctccagtagactccaccgagccgttcgcctggtgctcatcagtgggaactgtagatccttccagtcccatttaaatgagctgttgtctaagctagtgatccttcatcagaccacaagttcgacaccgagtagttgttgagaattatattctcaaccggtttgtcgtaagataggcagtctcgttcgctcgcagtaagtatgctgaaaagtagggggaaaaatgccatggatgatatcacatactaaacaccaaatcctctgagatagtctgccagggccgagtgggcttggaccgtgatcaaggcgggtttcggattcggactttagatgtgatttgttcttgcggtactggtactactaattctcaggaattactagagtgttgacagttagttgagactgcacaggatggcagcaacacaataacccattgacagtagataagtgcgacgatagactatgaaccggtcgttgtataaccatcattgacactggtatctttgatataacccttagccttgatataaccctttgccttgatataacccttagccttgatataacccttagccttgatataaagacctctagcctttatataaccctctagccttggtataaaaacctctagattgatataaccctttattgtcttactattgcgacattagtccaggaactatacgctcattgtctcacgcctgtcacatttttagatctgacagctacagtaagtactgataaatcgtgttcttgtggtaaacaacagttccgtacaagttcagtatgtactgtacagtgcttcattttgagccctaggttcgttttgagcccccgtttattgagaaaggaagtacagtgtttgtattgtgagagttgttgaccttgtgcaacaagaccctcttgtcctcatctgtctacagcacttgtacttggcttgtaaataaaacgggaagttcgaaagtagaaaaagatctccatgtattcttaggtagctccatagtaacaacaaatcctcacgtattcgagggtctacacatcctgtaaagttctgagctcgtatagtccgagacgaatgttcgatacgtgagtgaagatggagaagaaggaagttcagtttttcagctcaattgctttcaataatatttggggacgtatacgctctccagaatcattgaaacagatactccatccacctttcacatctgacgggtggcagctgaaagttcaaactagggggagggctaagggtgctagtgagggatatgcccaagttctacttacaccctcaaagatgataccgtaaaagtagtgaagatgactcttggggctcctttagacagtttttcgctatatcagagctgctgaagtatgtatctgaagtatgtacatacagtactgtacctatactcgcatcttttggagtggaacttggacagtattaagaacgagcaccccatgttgcgaaacatactcctcaccggctcatcacgaggtcttggaaccgttgaacttgttggagtgctacgctcctagtagaaaggaaatcctggagtttcaggactcggagcaagcgactcagaacggtatcaaatttgagatcaatgcggtcacggagtgcgagaacactggtgaagtgcgtgtcaggactagacgagctgacgggagagttgagtccatgcgggtttgctgttgcttttatctggccaatatggtctcttatgagcgacaactgcttgctcatccaccatcaagcttcctctcttcctctggctccagagttggccaatatttctctccaagcaaaataccagaagttgttgaacaggtctcaggtccaggcggttcatggagcggacaatttggcaggaaacctgtctctggttcaaggaccgccaggtataggtaagaccaaggccattgtttctcagctttgcgagattcgggcaagcaactggtcagactcacatcatgttatgtgtcccttccaatgcggcggtccatgagctgaccaaacgacttgagagtcacttctgggacgaatctctggactcaagattatggggggagggtcgtgagggtagattctgaagtagctcagtcgacaccagagggtaagaaacaagttatcaagacgcttctagagcaggacatgacagccatcaagggactggaagacgaaactaacagactgggaaagcacttggatactctgtacatgagcaagggccaagtgcatagcaagttgcaagagctgtacaagaacgcgactgccgagaatcaggttcaggtcttagtttcgaaacagagaccattgatgaagcaggtcaaagtaccgaaccatcagtatcgtcaataaaacgcgccacaaaggtgatacgtacaagagagacacactgaagcaatattaggaagtttgcattcctgggcagagaaaaggacatcataatgttttgtgtcaaatcacacccacagtctcatactgtcgggtttctggccaacgtgagacgcaagaacgttgcagtacctcgagccagaacatctctgtggatcatagggaactctgtggatcatagggaactcttcgactctctctgtcaacgcaaagtgacaagctgtgatacgagatgagtgccaaagaggcatgtccagtgaagcctccgagttccatatgagagacagaaaagccaagaagactgttaagaacggtattcaatcttctctaaagatccacaactcgactcccaggtcccatactgcggtttcaaagcccacaagtaggggtgggttccagagaagcatctccagaagccgggaacgggattctcgagaaaaaaagatcgacgtggagttcagaaccaagtctttgggacatgggagcggggagttgcttgtgatgtctcgttcgaagttggattcgactcatgttagacggagactgattaacgatatagatgaaaaatttagagaataaaatagaagaaaggatttttatttggtatttaaacaatgtttggatgaattggaagacgtaaatacccgatttgagccattcaggcaataaaattcaaactggagtttatattgaaagttcacttttttgatatatattgcggatttagctcagttgggagagcgccagactgaagtaattctcagtcttgaaatctggaggtcctgtgttcgatccacagaattcgcaattctttttgggaccagcaggcattcagagaagggcctctttttgctcctcgctctgctctatgtgccacatttgtcgccacgtacgagttctcattgttcaaattgtcttatttttccgtctatctaagtctatagattaccgtctggtttttccacttcgcacatctcgctccaccacctcggcaacaccgccaatctcctcaaagtggtcctccatgactcgcacctcctctcgtcgctcccagaaccggtcctcggccagatcgaacgcgaccttcttgagatcctttccgcgggcctctcggtcggccgaaagggcccactccaggaacttgtctgcagttcgcacgtagaaggctcgaaggacctcaaacggcttggggtgaggcagccagggtcggggatcgggaatggtttcgttggaaacctcctcttcttcttcctcctcctcgccgtcgtcttcctccacaccctcagcgtcgtcgtcgtcttcttcaaactcgtcgtcctcatcctcctcgtcatcctcctcgtcagagtcaacgtccgcctcctcaagctcccgcaggtcttcccagaacaccttcacgccgtccagcttgttgagatcaatgccatagaaggtgtccaaagtgaactcccggtcccctcgttcccatgagcctccaaacacgtaaagaacgtcgtcacagacggtcatggaagcattgaaccgaggatgaggcagttggttggcaataggatactccttctgcaccacctcctctccatcggagtccttgagagtctcctcctcctcctcaaccgcaggagtctcaccgtcctcacccagatccagcttgtccttgaaaatgctgtcaagagtggccttgagatcgtcgtctcggctgatttgggcccgttccaatgcagcctttcgcttcttggcacttcgcagagacagaccaaaccaccggttactttcaatctggtaggcgtacagctggttgtaaaaagtggagtccagactctcctcggtctcgtcggtgtcaaacactcctccaaacatgactcctcgacctcgatggtgcaccagagaagcaccaactcgaggagaaggcgcgtactgtcccttcttacgtctctcccaccgagaagccttaatatcggccttcatcttaagatgccacacatcctgatgcaccttgccgacaacggccttcttgcccttgtgcttgaccttggagtatcctccaaaaatgacgggaccctcgggactgggcacaaacgagtggcccgatcgagcgtcgggagtctggtgattgggagggaactcgatctgagtccacttgtaggtggtgacgtcaaaagcccacagatcatccagatacgtggtggactgcgacaagtctcggaaaccgccgtgcagcaagatgtagttcttccagtacgtcagtctgtgtccggatcgggcgctggggcccttcttctggtccagtttgctccattctcgggtttcggcgtcaaacagccatgtgtctccgtaatggtaaaaggtgttttgtttgggtgacgaaaactctcctccaaacatgagaatgattccactggggtgcgtgatcatctggtggccggaccggggcagtggggagttaccagactcaatcttcttccactgatccgtgttgatgttgtacgagtacaagtcgttgaagaaggcacatgttcccgagtggttcgacacctctccaccaaacaaaaacagctccttcttgccgtgaaccggcgaagtgcacatggagcaactgacccgcttgctcggccgctccacgttggtaattgtcaccttatcgtgcgcttcctgctccttcttgtagttggcgagaatctcgtcaatgtccatgtcgtcctcgtcttcgccctgcttggccgccaccttcttctgtttcttctcgcccttggcggcgtttttcttggccttttccgccgctcgcagcttcttggcctccttgtccttcttcttgtccttggccatgttgatgttggatcagattgtgcgaaaaataaaattatctataggtgaaacttatttctttttttatttcatgcgccagtttgccggtgaaactgtggttgaaaaacgtaacaaggcttcaagagacatttctcgacagctgaatcgatcaactaccaaaaaaacagctaaatgagggaaaaaaaaagaaaaagtaattgcgaattctgtggatcgaacacaggacctccagattactctgaccgaagaatgacttcagtctggcgctctcccaactgagctaaatccgcgtgattgttgttagaaaaagtggactttcatcatgatccgaagaatgtcaaaaagctgccgcaatggcaaaatggagcctctagacggatgatctggtcataagtatggggtctaccacttgaaatatttgagatattagaaaaaatcaagtttcaactgccgcctttgtcatcctttatctgtagggagctaatctaagactctctttctccattccaaagaaggactgatttccagtgcgatctcttgggccgatttgggcatgaattttcactcacattacaccgtatttacaacttgtccactccgctctcatgaagcagagcccagcatgtcagaaccatagaggaagtttggaggttccaaagacttggatctaaaccaagcaaattccaccattacccactttatggcatcaccggaattaacaactcttaccttttgacatttctctggaagaagctggctctacgacgacacgccaacatttggctactgttattccagagcttgctcgtcttctgatggcttcagcaagttctgtcgtactcaggacaagatgccaagttccaatgctgctgtgagagagataacaattgccgtcatattgctattctggaacccatcgtgtctggaattgacccgaccggcgtcccaagtatagaagaccgtaagtatggttgatgacttacaactcacttgtagggacactatgttccgataatagtacacaccagaaggatgtgtgtttgctcattcaccagaagagattttgtacatcagtggaatactatctacaggatggacatctcgtctatgatcaagctggtccccctctcatcttcaccacaagagaatcaaggagttggtccagtcacggtagatacatctaacactctgaaggaacggccatagttccattgagtacaaatatacaactgtgaatagctgttacagctccattgagtacaaatatacaaccgggaatagcaaatattgcttcaaagagctaaatgagcaagcataacatgcgactatctgttctctggacattgcgggcaatcttgttgaagccgtacaaggactcatttttatgcttatctgaagacttggaaggagcccagtggccactccaatcgtcgggcacatcgtgacagtcgcatggttgaatgatgtctccatatcagacagtgataatagggccttgcctgaagtcctcactctgtcggttctgcaatctcatccagtcacgtcaccaaggtgtgtctcacagtagacccaaggtgtgtctcaaaacagtctgctgagattccatccatacagaccgcataaacacatgtctcaaaaatagttccttttaagaacccctcgctatatatcgtactctaagccgtgtctatatctcattgtattccccggaagagcccgaaagagccagaaattattttcttaggtcgaggaacccatatcgcccgcacagctgttcaaaagacggatttttagaaacgaacgcccgagagaccatttccaaccacgtatcgacccaccgctcttctccaactagtcgtaaatcaatcacaggcacgtcatctcgtatatcggcgtttcgtaaatgccgatccgagagctacgtgttttagagtttggcgcggctgaaaccgacaaataacttttcgtctgttagtcttaaaggcgcacaaagagagaatctaaactcggcaatagtatcaggaggagttggagatggcgatgacatgctctgtatctctaaataaccgccacagcgtccacaaagtgcccccaaactcgtgcagccgaggatgcggggtgtgcagatccgaaaaggttaaatttaatggaacattggagatggaatgacgcctccaaatcggcatttcggggtatttgagggctatattataatcacaatccagtctaagcacgtttgatcattcatttacgccaaaaaattctctcattgtcgcacactttgccgtcaacaaggtctcattttagactgtcggcaataagtaacagtaccgagacctagtctcgagtttatctggatatatctagtctggtgatcgggggtggaggggccttcactcacctcaccatgtcgaccaaagacccctacgaggggctatctgaggagagcatcgccattctcaaggcccaaaccaccagtgagcccgtcaacgtcaactaccgcaccttgctacttcggtatgccacacctctggacaaggcggagattctggtttcgtacgtcttttcggcctgtgcgggagcgtgtctgcctcttttcaccctgattttcggctccatgaccaacgagtttgtccggtactttgtggagggggccacgccggctgaattcggccaccagatcaactacctggcgcggtatttcatctatctttttgcaggcatcttcgccttttctttcctcgaaacgtacatgcacgtccagatgggcgagaagctgaccggccggatccgagcacattatctggaggccattatgcgccagaacattggcttcttcgacaaggtcggagccggagaaatcaccaaccgaatcaccacagacaccaacctgatccaggagggcatcagtgaaaaggctggcctgattgtttcctccattgccgccataatttcggccttcattattgggttcatcaagtcgtggaagctgacgctgatcatgatgtcgtcgtttttcgccctactgttcgccatgactacagcagtctattttgtggtcaagtttgccaaactggccattgtttccgacgccaaggcgtcttcagtcgcggaagaagttcttggagccatcagaaacgtggttgcgtttggaacccaggacagattgacccaaaagtacgatgaccggctggtggtgtccatgaagtaccacattttccgtggccggggctcggcggcggctattgcttcggtgtggaccattgcctatctcaactacgctctctccttctgggaggggtctcgactcgtgtcttggggacaagtcaatgtcggaaacatcatgaccgtgctgtttgccgtcatgattggagctgtcatggtcggcaatgtggctccaaacttgcaggccatgggctctgccattgcctctggccagaagatctttgagaccattgaccgggtccctcccatcgacagcttctccgacaagggtcagaagctggaccaggttcacggccacattcagctggagcacgtcaacttccggtatccgtctcgaccggatgtttctgttctgcacgacttctctttggagatcaaaccagggcagactgtggcgcttgtgggcgcttctggcagcggaaagtccaccattattggcattctcgagcgattctacgaaattctcggcggaaaagtgacgattgacggagtagacatttcttcgctcaacgtgagatggctgcgacaacagctggctctggtgtcacaggaacccactctttttggcgtcagcatctacgaaaacattgcctacggtttgattggaactccccatgagaacgctgaccccgagaagaaacgtcagctggtggaggatgctgcccgtcaagccaacgcctacgacttcatccaggacttgactgacgggtttgaaaccaatgttggagaccggggctttctgctgtcaggaggccagaaacagcgaattgctattgcccgggccattgttagagagcccaagatcttgttgctggacgaagccacttctgcactcgacaccaagagtgaaggcattgttcaggacgcactggacaaggcagcggcggacagaaccaccattgtcattgcccatcgtctcagcacggtcaagaacgccgatctcattgtggtcatgaacaagggcagcattgtggaacagggcacccatcatgagttgattgagcaaaagggcatgtacttttcgctggtcaactcgcagactatcatgaaacagaatgacgacggctcagacacggccgctgacgacaaactcgaggaagacgtggtggcaatccagtctctgactatgagctccttcagtgaagatgaggaggaatacaacaccaaggagcagggaatcattgagatgattcgattcgtgtactcctacaacaaggaggagaccactttgctgctgattggaggagcgtgtgcctttgtggggggcattggctatcctggaatggccgtcattttcgccaaatgtatcgaggccttcatgactccgccctcaggctatccccacatgcggtctctgatcaacacctacaccggtctcttctttatgattgccatgatcgaaatggtggccttttacgtggagatttccattctcactcttgcgggagagcgactggtgcgaaaactgcgtctggcggtctttaagcagtttctcagaatggacattggcttctttgaccgagaggagaacaccactggcagtctgacttcgaatctcggaaaagacgcccacaacgtccgaggactctcgggaacaacgtttggccagattctcgtgtccattgtgaccgtggtggccggattcgtggtctcggtcgtcttcaactggagaatgggtctcatttgcggcgcctgtatccccattctcattggatgcggtttctgcagatactacgtgctcacatggctcaacaaccgggccaaactcgcctacgagcagtccggctcctacgcctgcgaaaacaccaacgccatccgaaccgtcaccactctgacccgtgaataccaagtctacaagacttacaaggaatcagtggagggacaggttcagggctccaaacggcccattttcttctcgtccattctctttggtctgtcccagtccctgtcgcctctcatcatgggtctggccttctggtacggcggaattctgctcaagcaccacaccatttcgcccttccgtttcttcgtggccttcattgccattgtctttggctcacagtccgcgggctcaatcttcacctttgcgccggacatgagcaaggccgccggaagcacgcggaacatcatgaacgtgctggcggtggagcccgagattgactggtggtccgaccaaggcaccaagatcgaccccaaggacgtcaaaggcaacattgagttccaaaacgtgcacttccggtaccccacgcggatgcaggtgccggttcttcgaggtctcaacctatccatcaaacagggccaatatgtagccctggtgggctcgtcaggatgcggaaaaagcaccaccgtcggtcttctcgagtgcttctaccggcccacgtccggcaagattcttctggacggcctagacctcgcagacttgaacatcaactcctatcgcgaggcggtggctctggtgcagcaggaacccattctgttctcgggcaccatcaaagagaacattttgctgggaacacaggatccggacgtgactgacgaggtggtatacgaggctgctcgaaaatccaacatccatgacttcatcatgtctttgcccgaaggctacgataccgtgtgtggctccaagggttctctgttgtctggaggccagaaacagagaatagccattgctcgagctctcatccgcaatcccaagattcttctgctggatgaggcgacctcagctctggactcggagtccgaaaaggtggttcaagctgctcttgacgccgctgccaagggacgaactaccatcgccattgcccaccgactgtcgacgatccagaacgccgacgtgattttcgtgtttgaaaacggagtcgttcttgagagtggaactcatcagcaacttctggcaaacagatcaaagtactacgagctcgtcaaattgcaggccttggaaggttagtggaggatagattaattgatcattttaatatgtataaaaatggcggagaattggtggtgtaatgacattctctgcggattgattaggatgatatatagatggacatattcatttgatctgcgtgttttcttacagcataatacattcattaattataacatcactttttttttttttttttttttttttttttttgaccaactttttcaactatttagttgggggttgagtcatgttggtgaaaaagttggtcaaaaaaaaccaacaaaaaaagaatgacatctctcgtcaaaaaaaacacgtgaccgtcacgtgattggacgacaccggaatcgaaccggggacctcgcgcatgctaagcgcatgtgataaccaactacaccagacgccctgagctgtgggttcggagctgaccgatttcgagtcaatgtggaagttttaaatttgaaattaatcattagaataaaataaaataaaataaaataaaataaaataaaataaaataaaataaaataaaaagagtgaaaaaatctcatatcgtgatatttttcaataatctaaaaaaccactggaatgagatagtttggctgattcaaatggtattgttttttttgtaatatgatcaatattagcagcgtgagagtgggatattcaaacagcgacttggtagggtcggagcagcagtaccttctgtacgacaggttgtggagcaagtgtggacgtgtggaactgagatactaaagtaattgcagcctgatggtatatataattgattcttgaccttgtcgtcattttctcagtgctccatcttccatatttgagattatgtcgagtattcaccaagtcgtcaattgagtctcacaggagtctctagacttcaagagtgtcgtccgacggccatcggagtgccccagaggactggagtcgtttccagaggactggagtcgtttccagaggactggagtcgtttctagagtccttggtcgttgctggagtcctgggtcgtcgtcagacacctctaagaacccacatccaccgctgaaaccatggggagagtcgatctacgacttgataaacaacggagctgttttgatatactatcttgccattacattttcataccctccaaagatgtccaagtcactccagtcgtcctagcacaagtactcattcatcactacacgctccaatattactctcaagagtctcctataaatacattccttatgtccactgggacagcgttccttacatggaacaacccccagcactgacatctaaatccgctgcgtaccgagtgtctctctctccttgtgcttcttctccacgtttctcttcagtctcttgactcgtctaaccacatcttcatcggcctccacatcggccatcctccgcaggtggttgttgcagccggcaacaggacactggtttcggccctgggtctgctgcagccactgcttgaaagcctcgccagagaacagatgcttgcacacaatcgctcgtacagggttctccaaatagtcccgtgtgatgggacacttgagattggactttcgagacacaaacagctcgtcgtctgaatcgtcctccgaaaggccatacccattgggttcgggggccaggccttcccgtcccacgtgtttcgaaaccagacttcccagagaaatccaccacttgtcgctgtcgccaagatcaatctcgggcatgagcatccacagcagcgtctccttgtgttttctgagatcacgcgactttttcagcatcagcgcacgtgatttctttgtgggctctggcagcgacttggccagggttgttgcgtacagcttggtgatatccggcactttgggtgcgttttcgtttgcgtccttcacgccatctccctcttgttcgtcatcatctggggtatgatcggggctttggttctccttctccttgtttgtcttttcccacgccacccatttttcgctggcttccgtgacctggttcaccaccttgtcaaagatgtcgctgtgcacgtccacgcgtccctgagtcagagcgagctccgtggcggcccggtcgagctgtgaaatggtcgattgtcggtcgtagatgggcagatcggaggactccacgtccaggtcgttgtcgaacgcgtccaccgtctctcggcttaaacggagcagttctgtctgaagagtgtggatctgctgggtcagagattcgcagcccaggttttccttggctttgtggcttttcagcgcgttggccgcttccttggtgaagatagctgtcatgtgtggtgtaggaacagtacagtagtttgacgcgtaaatatggagggtgctaattattagacatgttggcgaaatagagtttggaggttggagatttcgcggcagatgatgaagtcgttggtgggtgtatttggcggttgtgaaggatgtggagtggtaggatgtgatatgggggattgagagttgtttcaagtcgatttggacggatttgagaagaagaatggttcgcgacgcagtgtataacgcgtgaaatattgagtgaaagatttaagttaaaataaattaaaattaaaaaagaatgaaaaaagaaataaaaaagaaataaaaaaataaaacaaaactactatcaaaaataaaataaaatagcgagaagcccaaccacttgtatcgtacaaatggtctattaaaaacactaatgcaggcacaattactgtaaattaaaaattaattcacatattttgtctgaagggtatttttgtctgaattatctgtagggaacatcttcaacgctgtacatcacacccgctaataaccattggatcccatcaagatagtggaaaatggctcgactcaacgagtatgcagccgatatttcgcgcgggcatgcgacagcgcgcaccgaagaggctgagcggtaccaacgccaacgtctggaggagagagcggtccagatcaactcgctcatgcaccaactacgagagaaagagtcgtccgacggcgctggcgccagctccgggcgtcaaaacacagtggaagatcgcatggacgttgatgagccggaggatgacgagactgatctgttgctcgaacgagaacggcttctggaggaggaacagcgactactgggacgagtggaggagccagagcgacagtcacagggacggcgcgaaccaaggtacagggatgtagcgcagattcttgaacgggagaagcaaagggccaagaaacgagcccatgcgagctccaaggactcccccaagaaacgtattgctccgcctgtgcagattcaggatgaaaatatgttcgttcggggcgactggtggacggagtggacgtccgaagagcttatgatggtggtggcatactacaagcaagatcttcatcgtgctatgcaaggtcattcgggcttgaatcatgcggaactcactgctctacaactaggagagataaagcgactggtgagacgagacgctaagaagatgctcctggcccagtacagctcgagtctgaacaagatcaatgaagcacaggtcaggcaggagcagtctgaaaagcgtggtggtgaacgttctgaacctgtggtcgcgcaatatccctcgacgacttcttctcaaaacacaaacctctacactggtatgcccaaatccagccagcagacggacatgaattgcgagagcaccgccagcgacgacgaaaccaacgctgtggttgccaacaccactactctgtcgcttctggagccccagaacatcacgctcactgaggaacagcaggtcatctttgacctagtggctaaaggcgagagtctgtttttcacgggaggagctggaaccggaaagtccgtgctcatcaaggagatcaagaaccattgcgagtcaaagggagttgtctgcaaagtcacagcacctactggtctggctgctgtcaacgtggatggcataactattcataggtggactggcctgggtctcatgaaagagagcgccgaagtctgcattgccaagctcttcaaaaaccctagagctgccgcaatgtggaagttcaccgacgtgctcattattgacgagtgcagtatgatatctggagccatgtttgacatgattgacaccatttcccgagccgtgaggtccaactttttccaaattgcacacacggctgttgttcagtatgaaaaggagctacgttgtaagaaaaaagctcgaaactacaactttctgaaagaaatgttacagtacacggagaaggaccatgcgcgtgaccaagtgttgagagacctcccctttggaggaatgcaaattgtttgtgtgggcgacttttatcaactcccccctgttccttcgtttgaagacaagaacacatacgccagaaagcatggtgctagcgcccagcttcctccagactttttgtttaactccgaggcgtttcagaaagtatttggagataaaagactgcgtctcactgttgccaagcggcaaactgaaggctccgtgttcgcctccatgcttaacatgttccgaacgtacaagggtactactccagagactgatgctcttcgaaactacttttctcagttcattggcaggcatcccccgggccaacagactgtgcaccttcaaagcaccaccaccggagtcgaagcaactaatcagagagagctgcagctgctagatggccctgaagtcttcttttacgcttctgacatgcggaacaccacagaggggtacagtcaggaattcattgatcgggccatgagggacattaacgctgaagacaggctgtgtttgaaaccaggtgcccaggtcatgtatcttaagaacgactacgacaagggtttggttaacggtcatatgggtcaggttgcatttctcatgacctacgaaatgtacagtctgtacaaagacgatctggacgtattatttgtcatttatcactacatcaagtccagaaaccttcgctctctgagccgcaacgccaaggtgcctcctgatctggagcaacaccttggcatgcgcctggagcattatcaatggtcttactatcggtacgccctgatgcacattgacgaggtgtatcgacaagaggctctggctcaaaagaagaagaatcgcgagttggaagaacaaaagaaggtaggtagagagaacaccaagctactggtcgtcttcagactggcagacgagtacattgcagacggtgaaagtgaccagcagttcatcttggtgcctacagctgagttcgcaaagctcgactactctcgactgctggctcgtgagaatcgagacgcaaacgctcccaagtaccctaccatttgctcgcgtgtgcagctgcctatgagtttgtcttgggcactcacgattcacaaatgtcagggacagacacttatccgaactgtggtagacatgaagggcatgtttaccgaaggacaagcatatgtggccatgacccgggttaggtctcccgatgatctaagactcacatgtttcgaggtccccaaagtcacgcgtcctgaggtcatcaagttcgatgaatccatcaaggactccctgacggtcaagaaagaaggagctaatggtgtcggtggttttgcgcttccaaacaacgcccctcaccactcgactccttcaaaacgttcttctccgcctccgtcttcatatgagtctgcgattagtgattttgattctaacgcggaaacatgttcaggtactcactattaccgcacaagagctcagtaattaagacaagccccgggacgagcacatcaagacagaagcaaacgatcttgccaatcacggacaatgacccaccagtctaccagttgctcccttctcgtttatccagcgcctcctgacctcggtgatgatgtagtgagttcccaggccacattcagccagatcctgaatgtactagtgcagatcctgaatgtactgatacagatcctgaatgtacaggtgaagcgctgtcgaatatcttccgccaaagcttcacaggaatacacacaatccggtccacaagagaggaatctaccagatatttgactctgtcatgcaaagaggaagcagacagcccagaacaagacggtaaatgtagatgaccagagctccattgaacgaatgcagtactacactgccttttggtgaagctggtatcgcaatcttggtcttctcaagtctccactgcggatcggctcaaactcatttcgagtagatcattgaacatatctgttgtgaacagattcaatcaagttactcgaagatgtgaactaaatatttattcaagtgaagttatagttcatgtgatgaagcggaaaaaagcggttgatgctcagcgagggtgtcgaaaatcttgcccataagcactgtctgtggcggcggttccacaccagcctctagcgcactgcacacaattccaacaaaaatgtagggcagatcgctgtttgtgaaattgaagaccgaacatggctcagctggcttgtcgaactcggtgtaaggtggtagagattcgggtatagtctcctgcaagacggacttggcgatggacctctcaatcggggtttttagtggtttttgtagtcaatttccatggttgtgggtgtttgaaggagctctcaacgacctcattggctttttggagtagatgatcgagttgcgagtttctatcggctccttaaaaagtggtttgcagagagcatgccagcgacaggcgcagacgcgaatcctgccgtggtccctgactttgacgagatgactaatgaagcactgaagatctttgacgacattagcaccattgagttgatgaagaactggcaccctggaaacccatccctccttcccccaagatttatcaaagttcactggactgcttttcgcttgtcggcatacaggaggcatcgtatggcgtgaacagacacggcagatccgaatccagcaagatatgataaacaaatataagagaacttcatttgctcatgagcaatgatcttcatctaggcagtactgtactaccaaatttcccacaaggtcgtggcggtcgtatgatagtcacaaagagtacaggattattaccatctgtaatacttgagacctaaacaagtacagtacatacagtactgcttatcgttccaaatatcatatctaacatctgtctagaagtggaaagaggttccgccttagctcagcgcagcgagggcctgttgccaggagtgtcaaagttggcaccacgagcctggctgtagcccactggaggatatcgaagggaccctctgagtgagaatgggggtatctgcttgggtatcggtttgggtatggacagccgaattagagggggtatccagagggtgaagggtatacagtaccgtaaatgggctccgaagggggtccaagagtatacgggttgtaaggggtgtcctcaacgtgatcatgtggagtccaatgcacgtggaatatctgcctgtggaaagccaggaggagcatctagagaaagcgcgtgtcccatgttaaccagaaagtcacaccgtttcaagtgagctgctcggcttctaagtcccgctttcaggttttcctcttgtcagccaggtgaacacgccctgcgtcggtgtttctgatgagttcatgagctgggacaggtgatttctgtttgtcggagatcagagcctctaaagcagtcggaaaactttcccgagtcgtcttcctcctgaattatctgccacatgtactcgatgtaggcgtcaatgtggccatagttattgtccgcgactcaatcgagagtctttcgagcttcctgttcgtcgtcctgtttgagagttcatcatggagactcgggcagaaacagaatgagcgggatgagcacggctggaaacaccctttgccataggaattcggtacggccagtcgttgggtttggactcggagccggtgatgactgcaatcaacaggaactggccaatgacccatgacagggtgatgacagctgcaaacgtgcttttgaagactcacagggaagatatcagaaacataagttggtgtcatggtgttgaagacgccccagatgagccccgaaagcgcccagccagcacactgtttggccttgttggttgcaaagaatatcagaaacaccactgcttacaacagaaccaaggggatcatggtaaccttcttgcagccgtactcgtcggccaaaagaccgactcccagagagcccgtgattcggctaatgggtgctccaaccatgaaagcagtttgtcatttggcctcgattgtgtacgagccgtctggcaacccgacgccgaatctcggtctgatggaaggaatagcatagagggaaggaatcagaaacccgtcataaccgtccataacaatcggaaaacacatgactaggctccagaaaatgcatttccggtagatgctcaacgcagagtcagcgagttttcccattttgaaaggggtatagaggacgggcggtggtggatttggtgtttagagaggactcagatttttttgtcatggttaaggaagtagcacaccattccatgttgacggtcgaccatttgcatccagctgtagcagtgagataccgctaaggaatggtgctctttgttagggagtctgtacaagtacagtgctgtaccggttactcggttgatctgatcggatgaacagattgattcaacaagtttgtctccatatgtcgatgctgtcaacccttctccgttcgtataaaatccctccattgcaactcgacgcctgacggctacagagatcgtgatggtgtcaaaatatgggctagctcggtcggtagtaccaatgaagaattcttcacgaaggacgaggggaaggtagccgcgtgagggtggaaaatgagatcctagtcccacgacaggttctttatgttcaccttatcatctgcgacactcagtggatattgtacatgtcgttatcagatgtgggttgtttgtcttctttttgcatcgtctactggaaatcgcacttgtcagcagggccctagacgcccagttttcacccgttagataacatgtgggctggttcagagtggcgtcggtttcgtgcaagatgactccaaggtcctctggcacatgtgagtgcgaatgattaaccagaaaacctcaggagtctcgtctgagtagggaggcgggcgacacgcttgtgttttgggccattctctcccagaaaatggccgttggacttgtccctggctgtggacccagtgtcctcggtgatagagccactttgtgcatacctcgaccagagcagatttggagatcggacttcttgtgtggggccaagctgaatcgaaattatcccgagtggatccaggatcgaaaagtacgctcagcatctgattctgcacgtacagtatcggattcagaagatatctgaaccaagcagtggaagatggctggtcaaacccgaagacaccgcagtttgtgtccaagaccatcgagtccaacctgtgcggttccccgagtctgcaagaacttgggaattaacctgtcctaccaaatccaccggctctgaggaagctcagcagtcctccaagggcattgtcgaggtgattgttctgtgttgatcgagttacttccttcctcgaggactccaagactctggacgctgctgtcaagcagtatctggagaccattcagcccaagaccatgacttcccaaccgatatcagacccgagccattgttcatactgtccaattaatagctgcgctgattctgcatcgttgttaaggggactaccgtgaatggctggtgcttagtcacggttgagagcataagacattcaaggatcatccacatcaccagcaccctgatctctcgacggatccggttcaagcagcaggaacagtaaatcccctgttcgaacagacagttgtgagtcccagcaaatttccctgatcatcacacagtttctccaacactcggtctctctcaaaaaacaggcagctgctctgattgtctgacagtatctgcaacactcagtcaattttcgaaaaaaacccatcagattgcagttacctcactacgctagctgactttgcccttcccttcaattattgttgcaaatgatcccatttaattccatacgactcccagtcgcttccaatggctgtacctttgactaaactcgaattgttttccagaaaccggcttcaagcgtacatttcctcatgatggactcggacaagatctcatcgagcgggccgtcggcaacagtgcggagatctccatgtcgaacggtgcggaactttacagtatgtacagcgtgattatatctccgtctttcctcggcttccttgacaggtgtctcaccacacccacattctgacggaaagaagatagctcaggtgcgaatcaagttgtaaatcagtttcatggcactaagatttgtgagaattcacctgtggatcttccagcaacacagtaaatacaggaaatactgtacactatgtatgtacagtacatactgtagtgaactcatgtaaagaccagaagtgttcgaatcactcagagctaccattggaagctggctccagaatatgcaatgaatcattatttcgatatttatccattttctccaatatctgccaatatcagcccctttgtttcatctcttctcatctgatcttttcattggtttcaatatcagctcatttacttgcacatcatcacagctcgggagatttgccgttccatatcctcagataccctccacaggaatacttgtgagtatccgcctcactggaatcgaccagaaatcgacacttgttgcagtaatatgtcggggttagtcgcatcgggtcagtagaggagcagaagtagctgctgagtgtagatcgtaggacactcttttttccgccttctgggagctttctcgaagtgtgtgtgccagtaagagaagatcaaatccagaccatggtatttatacctcctgtttgttttgaggcgggtagttattgggcacaatggggcatgaagacggccctttgatacctcaggtgacgattggtgcgaagaggcggtttgtgggtgcagctggattgatgacaccttgtgaaaagcctttgaaaagtaccattttgtgtcaaattgatcaatcaaaggacccagctcaagggactcacattggtattgcacgttgataaagtattgttcaggttcatgtcgacactctcaggaggttgatatttaacattcaataatatgtgcagataaccttatttttataaagacgttttttgcacaatcacgaaaaaataattacgtaaacattagtaaatattcgtgtaagcgtacattcatttcaaaggttattctttcacggcaaagttataattaaatgaatgtatatgcagaaaaaaaaaaaaacacgaaaaataattacgtaaacacgaattttttttacgaaaatacgaaaaaaataatttgcaaaaacaatatatgcagagaaaatcaacaatatatttcaaaataatagcacaatatcaaaaactcacaataacctccacagcgtgcaaaaccgccacgaaaaactctccaacacagatggcgacacgattgttgacttgcgtaatcaacagacatgtgttactaccctccagcctactctccgatgatacatggcaagtcacacaaacgatttcattaacaagtgaatacagcacggaatagaagctaaaagaatggaaagattagttactctgggagaaaggacggactggtactgtcacagaatcacagaacgccaaagccctacagggatctggggtcatccataggagcatccaagggagcgtccggggcagtctcggtgggaagatcagcaggacctctggcatcggcaaagtcagctggaccagcagcgttgacaggaggagccatgccagggccagcatcctcagcagccacgttagcgggaccaggtccgccgacaggggcagcgccggtgaaaggtccaggagcgttaacaggaggaccagtgaaaggtcccggaacatcagggccagtgaaaggtcctggagcgtcaacaggagggccagagggaggaccagcaggggcatcaacagatggaccaacatctggaccagtaggagggccagccgaagatccagcaggaggaccagcaggaggaccagtaggagggccagccgaagcagccaaagatccagcaggactagggttgccaccatcaggagcgggtccaccaacaggaccagcattgcctgtgaagctacccgaatcagggccgatattggagctgaccggaccaggtccatcattggcggaagggccatcacgagaggctccaacggggtcagacttggggatatctgactcagtcattctagccggagaagagtctccattgggaccgctagacttgtcagaagaagcgtcatccttgggaccgttgttggcctcagtagaagcagcagaagatgcttcgctggtggaggaagcggcggcaggaccggaggcaacagcgggattgccgttagcatcaacagcaggagcagatccatctggagactggccacggggatagggttcagggtagccaaacttattgatgtaaaaggtcttgctgttgtcgtttccgctgttgttcccgctgttgtttccaccgttgaaactgttgttgccgttgtcgttgccgttgtcgttgtggctgttgtttccattgtcgttgttgctgttgtttccgttgtcattatggctgttgtttccgttgtcattgtggctgttgttgccaccgttgccactgttgttgttactgttgttgccgttgttgttgttattgccattgtcatttccgttgttggttccacctccgttaccatttccattaccgtggtcaccccagttggtgttgccgttgttgtttccattgttctctccaccgccatttccgtttccgtttcctcgaccagctccgaaatcgggctcaccgacaacaggaatcgaaacagagtcaattggatcaacaggaccaccctgctggtagacaaagaggttcttgatggcatcggattgagcgttcaggcttttagcaatggcctgaatgacaagggctgtggcgtcctggtcagccttggccgcctcctttgcagcatcgacttgctggctgaagatatcccttgctgcgctgctaacattgtccatgacctgagccacgatagccgccgtcacatcgccagcagagctgatttgctggtgaatgtcctcgatctgcttggcgagagcgtcggcattctgggcctggaaactgatctgctcgttcagctgctcggcggcggcggcagcggcagctttcttgggggcatactcttcgagctcacacagagcttgcaggttggactggtcaatgcctccctggttatcgttggaaccctggtcccgtttgatgggggccgcggttgtcagtgcgacaattgccgcaatagtggcgaaggaaaatctcatggtactgcgagttgttggtcgtggatcgcgaggcaccgaggctacacttatacagagaagctggatggtctaggaggtgctgccataagggtcaagctagacaaggctcttattgtccttggtcagatgatacctgcatattggcgcaccacttggagctacgaagaggtgctgggctacaataccgattgttgggtttggagtgaatctctgagctgtagcacgtggtggtttggagctactactggtgttagtcaggtcaggatcgtctcttctctctctgttgtcgcccaaggccaatggcatggcacatggctggtgttttgtctattgtgagtattgagaagacatttcagcacccatgtttcccagatgacggttttgcaagaatgtcagattcgaatgcagatctggtgaaccaggtacggttatgtcggtgtagtgcaggtctaatgcagcgtctagcaggggtgttagtggctaacggatagtccacgaccttagacacggactggtgtgcataaattgatttcatttgaagcgaagtgtttctagaacgtgtttttcgagaccagatccaattttattcgcgttagcgccgggattgtcacgcgggtaacggtgctacagatgtcctccggattcaagctgggcgtgagggcgtgactgagggggagccagggggaaatagtgggcaagccagggagcacgcaccgtccatattttttgctacaagacagttattactgtattggtagtccaaaatttcccaaagtggagttattgatggccagttgctgcggtttgcgcattattattcaggcttggtcttagtctacagacttagtgacggatatgagtgttaggattgatccgcttgaatgaacccaacttagtgacggaagtgccagtcctggacgagtctggatgagaaaacacaagagcgcgtggtacgtgagaacacatgggaaaacggcttgtcattttcgaaactgcgttgttacctggtcgtgcgccagatccgtggagctcgtattcactagacagctctaatgaagactaaacccgagctaccgccatagtcgatattgattgttgctcaagattagtatggggcgagggcatccaattgtgatctgcttgggatgtgaggacttgtctggtgttgttcattgctttacagtggtccaactacattgctgaggtatggggaaggcaagggactgacaaagtcagaagtgggcaggttcaccaggttgtaaaagtactgtacagtatgatacagtacatgatcatcaggttcaatctcggcagttagaagatgttgctaccgctcgcttgtgcaacattcaggcggcaaccgatgaccagagcgagtggcactgggttagcctggaacctggctgcggtatctatcgacaagccgagagaatcttaaacgtgccatctgtggacaccttgcagtccagaggctccatggatctctcaggtccagacaggggtgagctatcgagagcgagaggtagctccgatcaatagctgcggagtcagatatccacctgagactactgaaaacatgtctacacctgcagttgtctttgtctgactacaaagatctgcgggtatagacatgttttcaaatccagctcttccctggaccttccccgagccgcatgccatttgaagctgtcttcgcccaccaaatgcactaacctcaggcttcaaagtctttacggaaatgtcacagaggtcaaaatagattgagcgattgaactgccgacctttcaaggggtccctcattcataatcgtgtctacagtgccatggttcccctgacatactcggtacatctgctaacagacattgacaaagatgtgaatgaaaagaaccctcttcaatgtccagggaaacagactaattaagacagtacaatagtacaagtattagcaaccaaatcacagcatattgacaactattttttaatgattaaacgttcttgtcaagaaatgtgggctgattgagactcttggtccaaaggatactccacagtctagacttttctaaattgaacgagtgaagtacagtagttcaatgacaagtctggaaggcgccaattgagtcatttaaccccctatttcgtatctgaagggcgatttcagagtctgcaaattcggtgccactgggaatcgaacccaccatctatcttaaaaaacatttttcaactaattttcagattatgtcaggtaaatatcaactaaggaagtcacattagtcaactggattcaattcatttaataaaaaacatttaaaacaatttaaaaaaagcaaacaaaagctaaaaaaaaaaaaaaaaaaaaaaaaaaaagcacacatttgtgagaaaataaagtgctttgtgcgtaccagggatagggtaggtagtgaaatctgagttagtacatcaactctagacgatgggcgtcgcctgtgtagaagaacaataactcacccggtaactaacactatttctcggtggtcaatgcgtcagaagatatcaagacggtccgttttgcgtttaagccgagtgaatgttgcctgccgttagtaaatttattatgaaaaaccccactatgaatacatcagcctatactgatataccaagaagtgcaagggaggtggtcctgttccacctgaacgcggttcccgacaggcggcggtactgaagggctttgtgagagaggtaacgccgattctctctgcagtcgtaagacccaggtggtgtgtccgaggcagtatcgctttcccaactctagtaacctcggtagtgtgagacacactacccctaacggtaggacagccggacgacgatggcgcagcaattggcgaacgctgttataaaacaattcacttacgtgcaatgaaagttgtttgggcaataaacaataaatgtattagagccagacgatagacaacaatccagcagatgatgagcaggaaaattgagtaagatcgacgtggcaagaagagttacagttacgcagagttaataaggtgttgggagattagagttaccctgtcggatgactaactctccagagcgagtgttacacattgttcccaaaaattataattattgtgggtattattatgcagaaaaaaacacagtataattagacaccaaaaaaaattactacaccacacaatggagacaatcacaaagggatacccacaacggatagtcgaagaaaccgaaaatctggtgactcgatatcatgcatcacgtgaccaaagttctcctcagtctgcgttaaaattgtggaaggagactccaaatgagcctctgggcagatttgcgcgatctggggagagaaatgtggagcgggacgagcgtctggaatcggacttggcatttgttgcaggtctagtcgttgctctcaaaatccactctcaattcgaaggtattactgccattctagcgcgactttcgaagcccgcctcgcattctgctgttgttgttgccgagaagcatcttctggaggcgattgggtatgatctcgtgggttctagtgagatcgtgcttacgtgatggtttgttcatctgtaatcagtctttcttgggcgacagaagggcggaaccagaagggcagagactgaagggcagagatagaagggcagaaacaaacagaagtggccacagcaacgtcagcaaacaggaatttgatcacatcatcggtaccacgccttggacctgatgaccttggttatcttgttatcctaggcggctggccgaataccaatgaatgtggatcccgaacacatggactggcccactcaactcacaagataagggcgctttatcgctcgtgttgatacgtgcggttactcttaattgatcccacggcttgtgtgcactcctacttctttgttgcggccaaactgcgtgttcacaggtacatattgtacccaagacgagagaattcacggatgatttcagcaggatcagctctctctttcaaaaacgatgacatatatccatctctcaattggatctcattattatgactcgaatggacactgctggtccagttaccgtacagtaccatttaaatcactcattcagtcataggtcagttgaaagtacgctaaagcaaagagtgtggcagtgaatgagacaccgacagttcccgagaggttaactgtggcaatgaatccttctgattgaccggcacgactccagattgcatctgtgatttaatacgatttgattcgcatttttagttgaatttcttcacattttattcaattgatgaatgccaacctagacaaacgacacaacgacaacatggagtacttccctgacccatcttgactcagccaggaattctaaccgtatctggggctgaagaggctgagttcgggatggtcggtgagaagatgggtgaccagttcgggatggggtcgtgacttcgatgagctccagattccaccaaagccacaccctggcctgaccaatcttgaactgctagccgcgattatctaagacaccgcccacgcatttatcttgggcaaatctcgacgctgctatcgtatcccgcctctcgaaccgccgacaaaagttaggatgggaaaaagtttcacacacttccacaaggagaagtcacagtcggaaactctttgccgcggttaatgctattcagcgcgtttagatagcgaggaaaatatcctgccggagtacttttgatcggatggacgttggattgatggtgtcacctccctcgcaccgatagcgcaatgtgtcgataccagatacctgtatcagcaacgtcgcatcagatccccatatgaagaaggatcgtcaaaagcttagatacgttatcgtcatgcacgggtgaacatataacatgatctggggcttgatctggggcttgatctgcccaccatactgccgccaaaaatgctggacactaccaagatccctggaaccagcaattggctggagtcttctgaaatagtgaagctccccgtcccttcagacgaccccgacgaccctctcaactggagctatcgccgaaaggtgctctgtatggcatgtatgagcgctttcaccctctgctccggagtggcctcggcgtccatctactccattctggtgcctatttctaaagactcgggacttcctttggcgactctcaaccagggcacaggctacatgtttttgtttctcggcctgggctgtctagtatggcagcctctgggccaacagtacggcaaacgacccatgtacctggcgtctctgctgttgacgctagcgtcccaggtctggtcggcccacgctgccacctccaacggccattggatcggctcaaaaatcttccagggcttcgtgcaggctccaatcgagtcgctatgcgaagtgaccatctccgacgtgtggtttgagcacgagcgcggccgctgggtcggtttatacgccttcatgctcatgttttccaacttcattgctcccgtggttgcggctccgattgccgtgggccagtcttggccctgggtgctgtattgggaagccatcttttgcggagtggtgtcggtgattctcttcttcttctttgaagagaccaactacaaccgacacaccaaggccgcagtgattgtgacagagggcaactccgatatcaactccgactgcgaagtgaccgaggtcgtcaacaccgagctggcagagaagaaggggagcttccacgaaggaagcagtgtcgaaaacggacatggagacttgattcactactccaagaagacctatgtgcagaaactagcattgtttgataaaccccggccgatgatgttgtggaccatgttcaagcgaccgttcaaactgcttcttttcccagccattgtgtactcgggctttctctacggcagctccctggtctggttcaacgtgctcaatgccaccgcttctcttattctgtccagtcccccctataactttggcaccatctctgtcggtctgtcgtacttttctccctcaattgtggccggaattgcgggttggggaggaggatacatgtctgatattctgaaaatgtaccttgctcgtcgcaataatggcgtttccgagcccgaacatcgactgtggattctggtcgtctacctggctctagttcctggagcccttgttctgtggggagttggagccgccactcatgtgcactggttcggattgatcatggctatggggctcattggaggctgtggaacgctggccgctactgcgtctgtttcctatgccattgactcgtaccgagaagtggcttcagactccatggccaccgtgattgtcattcgaaacctcatgagttttggcatcggatacggcatcactccgtggctggccaaccagggctacggaaagacgtttggagaaggcgcgggtgtctgtgcgggatgtgggctggtgtttcttgtttttgtggtctacggtaagaaactgcgggacttgaccaaggagcgatactggaagttggttcaggagagtatcgacaatggtattgcccattagagagagagagagagagagagagagagagagagagagagagagagatctatttatagtgttattgattaaactaatcagtgatgagaggtagaaaaatgctaacgagaacaatgtctaggcgcagaaactcggttagtccctccagttggaaggcttgggaccaggacctagccacttgccgggaagagtctttccgtggagaacgttgtcaatgaactgctgaccaaagtagttggcatcaatgattttcttccacacgttgagggagcagaatccaaggtggtccgggtcgggcttgacaatttccttgccagtaaagtggaagacctgtccgtggatgttgacttcgaacttggcgtcctcggctcgagcacattcgatcaccagcagacccttggggctcttaggagtcaggccggtgtggttgtatagagtgtctgtgaacagagcccagttttcggggttgagagtgatggcaaaaggtccgccctgctcgacaatgacagaagcgtcctgtagaaagggttgtccgtcaagagtggccgaagtggagtttacctcgtagtggtaggggatgtttgagtccacaggagcagttgatgccagggcaagcagagaggtggagacgagggcggagaacttcatagtgtgagaggttgatggtgtggatgggtttaatttggagctaacttgcgtatttataacaatcgggatggttgtttggtagacggctcgtcggagttgactgagacgcgccgtcttcagagtgagacatgacgatctggagtgagttggtcgattcagggccgttatgagaagctgaatgtcgttgaacagtttacaagtgttaaatcagctaattttctgtctgccaatgttctgtctgtcaatgctgtgtctgtcaatgctccatccactatgttctgtctagccattcaccgaccccattcagactcactccaccaactccaaagcagtgatccacacgcacaatgacgtaagagacgacagtgttcgacatggatcagcatttaacccgttgatctccattgatgctgttctgaatgttttactactattcaattgctgtatcaactgtagacgataccatggttgatagtagctacagtatgtacagtaactacagtagtaatgttcaatgaaaggtcgtaacacaactgctgtatcggcatcttttggcaagacccggaggacggcaaactcggcttggttatttttagtaccgaccggctcggatcttcatctctaagctgcatgtctgagttgcgtaagtgggtatgggaagtcgattcgcttcagcaccgactggcctacggggatatttcgcaatgcactttggaacttgtatgatttatcaccaaatgaactcgtttccatgtataaaaacgcttattggtcacccattggcccacctcgacccacctcggagttttattctaggttccaactcttagttcgccaatgcgcggattctgcatgaacggatgagatgaaaagtaacctcccggagaagtaagacctcgccgaatgtgccaatgagaagtaatgacggagagataggcttggatggggctattggctagtttgattggctctcgggtgttcgaattcccaacagctagagttcttcctggaacggctcaggttaaaagttacgagagacgagagacgagacgagagacgagagacgagacgagaggcgagacgagaaacggcttctaaaagacatttgggaatggggggggggagttacggactggtcagatatcagttactccggacgttactgatattctgcatgcttactaagagcaccttcacagttgtacagttgaggtgattgctgaggtttatcggcgttcgaatctcggtcgaatcggactgagatgtaaaatgtttggactaacagttgtttcttaccaggagtctagattctcttgaaattcttgtacagtatagccccgtttttcttgcattcgatacggagattctcttaaatgatacattaattaaattattcctgaatcgaatatattggaaacaaaaatcaaaataaaatcggatctaaaaaataaatacataataatgggatctgcaattatatataaaatgggatctgcaattatatataaaataggatctacaaacggctctaagaccattctgtgatttggagactccatgtacaagatccatatattttttgctgaataaaaatgaactattaaataacaaatacattaacgatagatactctccttgactcggcgtttggagggcatggtgagagacaaggtgagagggaccgtttgctaatcgggccgttattgtcatactctgatggcacctctgaagagagagattcagtgtcccccaatcgttgaaggggaaagctgcctcagagacaggttcgttagccgttcacttcaggacgtcgactttttccattcaacaactcttcaatatgcaacatctacaacattagttccggttattcaactttacgaacatcagaagctgaacatggcgcacccgtttcactcctccgacgagtatggtctacagttaccaggtcggttctcgagaattatcgctagaatttggaaaatcaaccgtagatttgcaatgacgatacaaggatgacccgcgacctcggaaagtccagcgaaagagaacaatgagctgtttgagtctcgagcgtcagaggtggctgacaatcttcccgagtccgacaaagaatcgctgcgcacgaacaccaccactgtcaataacccctccaaacaattggaaccgagattgcgggcgtacagctagacgaactggctcttgtcattatcagctgaactgttgtcttcttccgacaccacgacctgtgcctcgcttaacagctggaaatctgccagttttggggctcccagatcgggaaacatctccaggttccccatgctccccatgtgccaggctaccaagcccctccggccggactaccggattttggaggacgacagaccagcttcaggcagcctggaggagcctcaggaggtcactgatcttagtcctgcctgctggacttactcatctccacgacgaccagattccttctgtcagagaagatatcgcctggtaatctggatatggagcctacgtcaactctcgccggtgttccaggggttacccaacggctagattgccatctaccaaagtgcccacacctggccaaaatatccttctggctggccccaagcacattgagagataacactgtctggttcgaatccatcccgtcacgggatggaaaacactgggagcctggaacattgagtccgacgccgttatctcatacctacgagaagaaccaggacatacaggtgtgattccgatggcaacccacaaaggagagacttggaacctctgcccaggactacaaagacaacgaccccaaactcggaacccgagtaacctcaccgggaggtgcctctcttcaccggaagaggtgtctcacttggcccaccccctgggagtaagtcacttagcaaaggggctgtaggtgggagtacaacgacgagtacaattgagtactgttttacggctagagatccacgggaggctccgtaatacgcctaaaaaatgctcaagttggtgaaattagagccctttcaacatactctagtctgaaggctaccattcgtgatgatgtaatcagacaaacaaggccgggggagagcatgtgtgctaccggtacgagtactgtaccgtattcgtacacgtatcgtatctcagagctcaaatcaataggacaaatgagtctgtcatttgttgtggttgttggtggatgtctacttgaattgggtgagtagtttgtcgacgaactgccaaaattgaactaatcaactaatatcaaatggctgcaactattttctgattaaaaagtattaattgaacgttgctacaatctcaaatacaataaaaaatcagtacattacctatgatcactcttcaatcgttgacgacaaaaacctgcttataggcatcaatctcaacaaggtgatcgagaaacacacaggggactttggagctattgacgagttgtcgctctaatttggctcctttttccgtgaggaattccgctcaaaatcaagtaaaatgttcataaacttgcacaaaacatggtcgttgattgctccatcgggagcgtccttctgtctcagctcctgaagccgtgctctggcttcctccaacttccaatgtatacaagaaagtccagcctgttcctccttgacatcaacaagtgacaacgaatttggcgccagttggatccagcccttagcttcgggattcagttgtttttggcgagtaagttgctcccccactcgtttgatttttgcgggaatgtccagaaatacttggtcggagttgattccgtccaactgaaccggcttctatgtgtactcagacacttgcttctactagacagagctgaggggagcattcaagatcatttctgcttttctccagagattcaccgcgctacttcacgacgactctccagaatcgcctttcgactattaaaaacaataatgagctctgagtttttgccgagatgccccctccgctggttcattcgagttttgtcagaaagctgctcactccaaagtgcacagacctgtgcgatagtaccgttgaagtaccgttgaagtaccgttgaagtactattccttctctttataaaaggacagtcaccactgcgccttttcatcgcactggtccactttgtgaagccacctttcattgagaactcctggtcaaccaggtgactggacctgctggcaagccggtatcgagagtcgcaatccaacgccatttcatcttcaaaagaggccctttcaccgagggtcttgatctgggtgtagaagaacttgcggttacaaatgagacttgtagtctcatcgccatgccgtcatcgacagtctcgcgtgacggaaatgcaatcactgttgcccttgtcgatcagaaagttgcgaacaatgagatgtccatggtcgacgcgagacatgaagcatacccacgagagaattgagccctcgatattgtcgggctcgcgaattctttcaacccactggaaaatcttgacaccgttgtgactgctgggactgatctcactcagcttcctctccatgatattggtgtgtcgtctctttaacaccaggtaggaagacaacaagtcatcggtgagaaagaagttggtgatgaaccaaatcaacaagcccggaatgttggctttgatctaaaaataccgactgttaggacctagaatgtccttacatctcgtcttcttgatattgtagaaggactgccgaatgaccatgcatcaggtttcggatgtcatttgccatgtccttgatgtccttgatgaaagtggtgaagggaaagtagtggctggggacccctttgatgtcttcgtccttgtacttccttgtaggctttcttgacatagtactcctgtttccagtcgtggtacgcaattcgatagtgcttatgcgcctcgtcttttgcctctctagcctgcttattggtctcctttgcccttcagagaaccatcttccctgttcgcttcgattcaataccaactagctcttcttcctgcccttcctttgaccttctcgggactctcagacggctgagcttcaagtaacagtcgaaggaactatgcttcagtctgcttcagggcttcctcagatgcaccaatgtccgaatcagccttagagaggttggcctggaacttccactcctcctcttaggacttcttcggcagaactgtggtgtcaacctcgcacttctgcagtcgtttgatctccagagagtgtttttccacttccacaaccagcaggtttctctggtccagtctgttctgaatctcctgtttctgaaaacgggggttcaagaaacactcctgaacctgtagttggagaaaagtggtcatattgaagagtcagggcctccatgactcgtttctgctgttcgatatcgtacaccatcttctccccatacacaagtttgtgacggaaaggaggaatgaacttataaatggtctcaagaagctctccaaagctctggagacgagtgcggacaatgtcccagtttcagacggacgtgttcctttggtctggagagattgtagagtaatgttggtacctaggaagacaggggtccccaaaggttgtcgtgaaaggaattttctgtttctcgagcaccattcttggttgagccttcaaccgaaacggtgcagatagtctttagctcgtcgggggcttcggaacggttgagaaggtcctcaccgcctgagtctgcactgcttgggttggcgctctgggaaccatctatacacctgagaagaagatagacgcgatagaagatttcatgaggagtgaacgtggagcagccattgaggctacaatggtagctgagaaactgcccagggttgaatcgtgggtcggcgtgacgcttgctagtcatgattgggtagaataagggagaaagaagcagaagttgataggtgttgacctggttgaaaacggaagattgtgtgaccctgaggggtgagggaagcgtcagcttttgaagcagcaaccgagattgatggcaggtgtagcaattgatgaaggcgcagcaataatccagataacaagtttgtctcgtgtcgtccataacttcttctcttgcggaatccgtttttacaagtacttgtgcagcactgtagtgtacagtacaagtcactgaaatactatgcataatcggtgcacattcaatgcacaatcaatgcacaatcggcgcacaatccaggtacatttatgcaaccacttgctttgaaagtttagtcatccggcagagtaactccttcttcgcaacaactttttgttggtataactgcacctcttctcgtcacatcgacctctatccattcttctgctcacagctgctgatttgtggagttgtctggtgccaataccttctactgattcccgttcgccgtcgtcgtccgacaaacacctgggtctaccaaccgcagggagaatcggcccctccttcctcacgaagctctggggttggccgtccgttgagaactgcgtagaggtctataggaacatttccatctttagttcaagtcattcaatcgagaagataacgagtcaatcaccgggtgggcattggatatcgctaaaaagactacgctcatcgtctagagttgcgtatcgactcagttgtcctacttacccaacccctggtactctttgtggctatatcccccacatctggtggctgacacctcgtttttgtctctcatcgttctcgactttcttccaccctgccagacaacgctgtcttccgtgtggattacaaggctctcaacgagtccattctctgcctcgccgccaaacttgagcaacttgcggagagagcagcagaatttgtgctctgttgtcgttgatatcctcgattggatgcttactgccctccaaagtcgttaggacaacatggggttttcccctgccagcgatcctccagctgcctttagtggcgagggcactgtcccgggtggtgccgatgaccttgactagggctcttccgcctatcgcttctctactcctgtccgtacgcctgcctccactacttccctgtctggcaagtctgaactcggtccagatcttgagttttcctacgagagtctcggtagcgggaattggaagacactaatcagctcctgctgctttgttgtgctcttctcctcaacaccaccacgccctgtcagtctgtatgaactcagggatcctcagccatttgttgctgccgcctgtaaggcctattcggatgacctcgctaacctcaactagaccgaagccacgcatcggttcagcgcgacctctgtgctttgctcaaagaccttttccgcaagaagggacttgacaagcccccattgtcatatttgccgaccacgaaaagaaattgcgtttccggttcaaggagtaccacacaaacttttgtctggaaacccttcggctctttctagccatgctgggaaacgctctcactatctcccccttggccctggctcaatttgctgctgcccctcgcgtgaccgccccgattccagggtctctactgggtggcttagccttggttttgactcgttacctgaacaggaccaccaggaaggcctctctgttgattgagcccctctttcaagcgctaattcagatttctcgtgatttggtgaactacaatcgacctctgaagaactctggcaccttcacgctgtgggctttgccaacgtttttggatgtgagttactcctgagcagcctgtctcagagtccatcccggggttcaccactggccgtggaatatctaccaagaggcccacgtagactgcagatcctgtcgccgacgccgccgctccagctgtccgtcgggggtttactccctctagctgggcggcacttgctgagtgatggatagcagccatggtgttgttcaaaaaccacaagatagtaagggagttttgatgtatggttcgcccttcgagtcgcgagagtcgctaaagaggctagatacgtgcaaggaaacaagtcaacgatggtcatggcaaacaacagaagaagcgtggttcaccaggtgtgtatccgctggactatgagttccttggtcaattgatgggtgatcggattgcagatgatattgtagatgggatgaagagatactcgtgccgttattgacgacgaccaatcctagctactttccttacggctcccttacatgagttgactacaggtagaggcacgaccaaatttgaagggtctacagcgggttgggaaagacgccgatctacggaaaaggctttcagggcacttcagaaagcgttgacataggaactggttcttggtctcatccagaaggccagctccgtgtaacgttggacgtctctcagtttgaaatttgtgcggttcagacgacggcaagaaggagcagcgtttcgtgggcccagtcaagtgccttcgtgtatgcgaggagggtatcaaccacaaaatcaaccacatcactgtccaacttttgctgtcccagaacgcccaaacaattcctcactcgataactctcgtcgatgccttcagcgggtgccccttaccaggctctatgtgacttgcaaggctgtaacccgaccatgatttcttgcttcaaacgctaggacttcaacgagcagaactaccgtgacattgtaggtcgttcccgggctgctctggtcgttcccgagctgctctggtcgttcccgagctgctctggtcgttcatcggttttgtccctccgggtttctacgttctccgggtttctttccggaaacagtgtagctaccctcgctgccaatcgcttggaagccctgattgacgaaaagcgtggataatgacctacgggttagtggggagttctcaagaggaccacctgcccttacaggttgatgggtggttcttcaggagggtcacccacccatgtttcatacctagagtatgatggtgaaaggcttggttcaagggttggggttgaataggaggtttcggagtctcttcttcatacttgtgcctctattggactacgactaacactaggcgagctctccggtattgagtaatggagtattgatggtattattgccgtgatgaagagatacttggtactagcatggacaatggagggttatgtattccattgatgtaccgatagctgaagtttctggaggaaagatgaacctgttcgtccagtagcccccaacctccttgagatcaccataacagtttacaaatctccacatgtctcctcaacgaggagatagccgaaatgagatacgagtggtttctgtacaaacaacttcaacgatatcttaacaatgttccatgacatacacgacttacacttggtgtttcaattgatcgctacatctcatttctacattgtggctatcattggtgattcgcagtcgtgtgtttttgttttgaacgaaactgaatatgatattgagagttactaattgaagattaaagagaattaaagaagataatggacctgaatagcaactcacagaagagtaagggccattggaaggacgagaacggcaccgatagccagtcgggaagcactgttggcctggatgggaaactcaaggccgggaggctgggcagagagaggaactccgccaacgctgattgagccgtccccaggtcccttgcttgtctgagattcgttgggtccagatacagtcgacaccatgtttttcgagacattaacgctggtactcagcccagtgaactcatcttcggagtttctgagactggtgtgtgttgtaggtctaggagccacgagagcggagacaacactgttggaggcgatggccatagtggaagcaactttcgggaaaccggtagtctgcttatactggacactgctggggctcgcatgtatttctatcgcaacggtgattccagtagaagtcttggtggcgacggtggcgcccgtctcatgcacaaaggaactactgatggtgtcagtgggagacttgacttcttttgtggatccaaaatgcacggagtcagggacgactgtgatgatatcagtcgaggaagttgcagaggacttggtattagcagctgttgggaccgggatgctgacatctccgttcgacttggtcagtatttccgtgtcgataacggatcctacaagagggctggtggagaatggagtactagtcgcctgctccatagcgtctccagtggtgtctctgatggtttcagctactttggagtgtccaaaagagatggttgtggcgacgaaagcagatggagaggaatctttcgtggcaaaaacagtgaatgtaccactaatacgtgtcaaggaaggaacgccagttgacgaggtgcttccagttgacgagaagctatcagtggaggcagaggctgaggaggttgcatcaacgatggaggaggctcgaatgctggttacttgctcgaaaaaatctccgtccgagttgataaggatctctgtgccaacaatggatccagaaatagtgttggtggagattggagtgcgtgtcacttgaacaaacaggtttccattggtgccagtgaggatttccgtaccttctctgtatcctgggacaatgtttgtggaaacaatgctaccggaggaacgagttgaaaagataggtgggcttgaaacactggttacctgctcatagaagtcaccgtggggattggtgagtgtctcagtaccagaagattctcctaagacagtgtttgtcgagaccacagtgcgcgttacctgctcatagaagttgcctttactatcgacgagggtttctgtgccagcagtcagacctagaacaatgtttgtggagacgggaacattggtaactacttcatagaaactgccatcagtgttctgaagagtcgcggttccagccgtgtggcccggaaccactgttgttgacccagggatgacagtagcccgaacatagaacccaccatcagtgtttcgcagagtttcagttcctgctgtatggcctggcacgaccgttgttgacgtggggacgacggttacctgctcataaaaactcccattgtggttgacaagggtggcagttcctggtatcaatccaggaacggtgttggtggagacaggaacactcgtgactcgctcgttgaagccgccatcgctgtttcgaatagtggcagttccaacaatatgacctggaacgaccgttgttgacgtggggacgacggttacctgctcataaaaactcccattgcgattgacgagggtttccgtgccagtgactaaacccggaacagtgatggttgacacaggaacgagcgtgaccacttcataaaatccgccgtcagcatccgtaagagtcgcagttccagctgtgtggcctggcacggtggttgtcgaggcaggaacaactacaacctcattgtagaagtttccctgagaatttaccagggttcgtgttccagcagacaatccagggatagtgttggtggtaacaggaactttggtaatctccacatggtagcgaccaccgctggagattgtggtggttccagctttagtaccaggaacgacagttgtggcggtgatcgaggcaagggggatacactttccagcggggggccagttgttgaccaccgtgacttgttcttgggtctccttccatctagcagcctgctgggcggcgtacatcttgtacacctggttgatggcttcgttgtactgcgcaagagtgtacgggggagagccggatctcgaaagccagtatttaatggcatacggatcacgcatgggggcatagacactgagcacatcgtaccaattcggagggtcacagaaatagggatagacgtagtaggcaaagtcctgctgcttctggagatcctccagaacaaaggagtttccgaggtttcgggcgtcactcttgatcttctctctgtcgacatttggggtgatgtttgtctgcccatttgcgttggctacttccttagcagcggccacaagctgtttgatcaggtcatcagcatcctgagtcaatagacgaggtggaatgtgttgacggatgttttcgtcactggtgatagtagcatgcaccgtggtggcgagcagtcctagcaagatgtgagatatcttcatgatcactcagttggtgggaggggggggattgtttggtggtctaccattgtcgtcgggtttggtacagtatatataatcgactgtgcccttttgtccgtttcaagagacatccggagttggggtttggatctacaacctgcatactgctagcacagatttctgggcccatagcaaagtgaggcactatcccggcaagatttctgggcccatagcaaagtgaggcactatcccggcaagtgatcccccaccccgtcaagtgagccaccatcccggaaagtgagccaccatcccggcaagtgatcccgcaccccggcaagtgagccaccatcccggaaagtgagccaccatcccggctagtagctgatgtccaaaccgaccaccgtcgcaagtgtttctgcctctgatcctgtctcatgttgatatctcgccattgcattatgtcccgctcacccgttctctatcgggcaagttggtcagtccaattccaggctaaggtaagggtgagcgatgcacataacaaaaggactttaggcccggttagcagaagtgctaggagttcagtggtgattaacatttaatactgggtctaaatgttcacagcgactggcgaagaatgtcatgtctgatggagatggtttagacataagcggtggagcgggtgtgtttgtcatcttcagggtttcttcgtttcctctgatgctgctcgagcgactgtcgaacgggggttgtccatgaaagcgggagattgtgcgtttggcggatatcagcagcgctaggccttagtgagaatgttaggtgagtggatctgatctatgattgttgaatgggcgttcctggagtgggcaggacgcctctttcgctatttgaggggcatgtttcgtgcgaattggccaaattaagcaagaaattcagtgaagaatcattcaatgaagaaaattcgacgaagaaaactgaaaataaaaataaaaaatgaaaaatgaaaaatgaaaataaatgaaaataatgttgcaaattctaaaatgtgaatgatttggaaaacattcaaatgagctggaaaaatactgaaaagacttgaaaaaaacgtgactgacctaagatcgcgaatatctcgacccaaaaaactcgttgagatggtctcggacactaatttcgtcaagtgtttgaggccgtacggcatcatccagactaaaatacgactttgtggggggaaatacaactttttggggagggctattcgtgaaaaggtgggctgtttgacgcaagggtgaggctgtgctatcagcagcaactctggaccttttgtgtatcattatattgggtgaatgccccgatcttgcttactgttctgtttattactgtgctgggggtatcttcacattccgcactatttggcagattgggaaatttcaagggcggtgctattttgaggggttttagtactgcaaaggtcttataatatctattttgtttttattattactattattattattattaatattaatccaatggaccaattactaatacaacacataattgaacttgcaaaagaccaacagaagctgatgataaaactccatcatggccacaattacttgaaaatccttcaataaataatcgggtctaacagcctccattgtgatattgaaaaatgaggaacggacttcgactgaatttgaatatggaatgaaatgaaacttggactgaactcggaatgaacttgaattttggaatcaactcggaaggaacttggaataacttgtaaagactagagtaaaggaaacaatttccacggtactcaaattccacaatactcaccggtaatatggtacggtaacagctagactactgtaagggattgctggtgagccatcagagttcacgctactgtatgtactgtagtccaattttcctgattaggggggtggtatcatcgggatctggagttgatgaaaggagaaacgtcatgggactccacaactcccctcaaatcagctcaattgacttcattttagcataccattcaaacaaaagtccattcttgtctgttgggttcgctctgggtcagccgatacaaaaccgactaaagtcccctctcaggcaactaatcaccaaggttgtaactagcgacctgaatcgagcacctacaagtgcgatacggtagtctcagactatcgacacgtacatcggagcgactagttctgttgtggaggtctgtctacatcttgcttcacacagacaactgatttttttggttgaggcggacatcgccgatccaagtcctcggagattcgtagcagacttgtactagtatccatatactcgtcgatcccctcggaatatgtttcaacttggccttggtagtgtgcccaacttcatctagcgagtagtagtgttgtagcgatgaaatatgccggttcgccggaatgaagcacactacatagatcggcgcataacccaatggactcaattggtgcactgtacatcgacaagctgattgttgacggtggctgaaaaagtgttcactgtacttgtagcaactccgacgagttttgtgtttcaatgttgctctgttggaggtcaacaattgttcaaaccatgaaccagcatccccaatattgctgagattgaaagtcgggatctactggtcaccacatgcgtttgcggtacagtcaacggcatcaactaacaaagagctattagccaacattatagcacctgttttaccccatatccccaacgtgatgtgcacttgttggtttcaacaccagcgagtgtgtgagaactagcaccatgtcaatagtaccaggctgaatacctgctgattctgtcattcgtgaatgcaatgaaccgacgaaggggaattccgagcaggccgtagggtggtttgatcatgatttggcgagtcaccatcccatgggtgaagaggattgttcaaaacaacacagattgaccacattcctctcagatatagaaacttgtagtacacgctcagtacagaagacaagacaccattagtgcagggccagtcgagccccccccccccccccccccccccattgatccttttgggaagctaacaacgcgttgaaattctgctgcaaattgtcgtcgttatgtgaggagatgtagatggacacaacaggtggagaaggcaccttagaagacgtgctgatacagatacatagttgtaaaacactgtcgatgctcgcgaacaatgagaatagtcgatcgatctaccgactttctccatctgtcactccaagacctttgcggttgaatcgtctcaggaccattatagcaccctggcagccaaaaaagtgtgctcctactcataggtatggtcctgtatcgtcgtacgagggtcggtatgggactggtgaacggtagttgacctatagcggtgctcaccccaccatggacagggtatgtccatttatcctcgctgagtcccgaacttgataccaatcagagctgccctgttattagcaatacccgaatgtgcgtattgaccaatataatggcaagagcgttgaaataaccagcaaccgtcaacaacactagaacaccgccaaatatagacctcttcgtggcctacaaggatcgaccaggtacattattggaactcatttattagcgaacatgatgagctgaggttggtggtggtgatatcgtttaacagaaacggagatgggcagacagtaccgatgtagggagaactgagtcgattaatgaaaagaagtgaacgacacatctcgattaaaacagtacatgttagtatgtactgtcatattagtatcgcccttggtttgtagcctgaaacagtgataaaaacatctctgatgccttattaggtatcaacctcgtctctggcaatgctacttctgttggtgagaaacctgcgagaagccacgagacttatttccatcaataatcttggctttaccaagagggcctctgacctttgaagttacactcccccctctcgaacgaattctgtactttgactgcatattacgcaccatggcaactgctgcgtccgccgagtaaacaggagtccccgcaggtgtgcgggcatttgagagaagttgcattgaacctgtagtcgaatctccggtcttagtgtttggatcatctttgagcgccggttgtcgatccaccctgccagcaggtttggtttcgactggagtaattttcactagagatgattcgaaactggtcttagatgagttagccacacgatgcatatacagaagcaattcgagccaacgtgataggggatgtctacttttagtttcggaagaaacatgatgcaaaaagtagcttgctgaaagattcagagtgcgatgaagctcttcctgaacatcctcctccaaatgatccaccacttcatgctgagccgtcgtgttgccagctatcatatccaagtaaggagaaatgtttagtcggtcccagctgcgttggtctgtcagagaaattgaggtccctttaccaggtatggcaaagctcaatttgcatggcgtgttcttcatgttagctctacccgggtaatacgaacgaggccaagtcatgtggaatttcctttcgagcaagtctccaaaagacgacgccaatatgtattcccagcaggcagcggggcccctttcggtatagaaggataaattctggtcaaccttgagcttttgtagtgccgtttccagtctctctgtgatctccagaaaggtcccggcgagtgtcgctggcaagtcgcaaaagatatcttcgccctcggtcgtgtagatgcaaaaacgcgtgttaagaggtggaagcccctgtacaacgtcctgaagaaggctcacgagcgatgcatgttgctgtccacggtcccaagaattgacacaaatcatgaaggctggctgattgtgttttctcacaaaaagatcgatatggttgcgcatatatcggctgattgccccaagactttgctgctctcgttggaacggagaggtgaaagcgagagctccagtggcagcatcaatgaataagacggtgtacagtcgatgagaatcatcttcaataaagtgatcttgtggcaatcgatacagcgcaaagtagaccactccagccccgactttggggtgagcgaacgctttatgttcatggagatggtcaaaaatctccctccaaatttccgtccgcttctcagaaagtctggactcgtttgctgctgcgtacttcaattgttcttgtcgcgtcttactattgcccaagtcaacattgtagtcgaggcccatgggataaagactccaagcaacaacttgctctatcgtggactgggaaatgccgtggatatggaaggtatccaccaatgaggttgcgatttcaagggcgtctgctgtgtagtccaggagaatgtgggctgccaggatcacccaaggaacagcatcccgggccaaatttaccctcgtaacctcttcacctagagtaatgtccttgagctcgtccgtccagatatgtgacaccattcttttcgccataaatctcctgttgaccatgatgtggacttgcggcttgaccgactctaccagcttggccgaccaatcattgaagaggtaggaatagcgccggtggacatctaactgatcggggagtccaacggcattgtagcaccgctgaatgtactgtttcgcgtccatgtcggtcgttcacgtggggtttacgtgtcggaaggccaaacactacaatgcggagttgcaacacgttgtgatggcgtctctgattgcagcgacagagctggttggaggcgtgtggctctggcagttggagtgatgacaaggttcagacaagaccaagtatagatcgacgattctgttgaagcccgcgaaacctgggtttcggatgtatatattaggtgattaagtattgtccagttatggcagaggttgcgaagccagggagactttcagaaacacatctcggggacatcatagtttttgttttgtttttcgctttcgattatgtttaacaagatgtcaacaaatgtaaactaaatatcaacaagattttggtagataatcaactgatctctactaaggttacctaatcttaaccaatgtcaactaatgtcagctagtgtcaaccaagtgtagacacacttgagagccagaggagatcaaccactagagaatgggcattggactttgaggaagccggccaacatccgtgacaattgccagagtcccggtctgatctcattgtgtatattttacacaattttttaatatattttttaattttttaactttttcagttcgaattaaaataataaaaaagcgtcgcccatgatccacagctcttacgcttcgatgtattgaagagggttctcgacatattgaccaatgggattgatgaatgatgatggtaaggacaagacttgaacgcctgaacgacgacgactgaacgacgacgactgaacgcctgaatgacgacgactgaacgcctgaacgacgacgactgaacgacgacgactgaacgcctgaatgacgacgactgaacgcctgaatgacttttttcgactgaacgacgacgacttttgtgcgacctctgtacgacctctgtacgacctctatacgacctctgtacgacgattcatctgatccgcttactgtacccacaacaaaaccactgtactcataagtcgctgctcaacactcgacagctattgtcaatcaatactgtgctccacttctccacaaaactcaaccaccccatcgcaaacatgaatcaaagtggacacctctcgtcaaccccctttcaaggacgtgattgagtggtccacactcccatgacgaactgctggtcagaatgggccagatggtggaccagaaacctgacagggtacacagaattgcccagctcgagtccaagctcgatcagccagtcgagtttctcactgaaccacttccggcgttgttgaaagactttcccgaaattgctgtccgtcgaaaagtgcattacagtgcctggcatcaaaccaatgggaaaagctggagatcagtatgaaggtcattgctagttgacaaacacactgaattggtctctattcggtcgaatcatcacctacagcaccatacttgtcctcaaaattctatattgctcagatgattcctgacctcatagatgaccagtgttttacccctgtcttccaacggtaccttcagctgttccgctgttgagaatctgatcgaagagcgcgacttctcaacagaaaagctggtttcaaacaaaccccatgaaaccatacatcatattaacgcgatctggacttgggtatttgatccaaattgcccatggagtacaagtccgaccgttatcaaatctttgactacctctacaactctctgctaacagctctgacaggatgcatagaaccagggggaagaagcacccggaacagtagcagcagcggagacagggactcgtcgaggaagcacgtcatcgtacttcttcactcctcctgaggaaacagcagttgtcaaagtaattgtattctttagagcagcctcctcccccttctgaatctggctcagagacttggcgggagcagaaaccacagaatcagtggcccaattggacttgagagagggcccatctcgggaagcaggccgagggtggatggaatcataagtctctggcccttatcaacgactacaaaaccaacctcaaaatcggagacaacctcttcaaaccgacgccctgggcccccaacagacaataggggaaaaacctgaacctcatctgccagtctaaacccccccaccgcagctactatcgccaaacaccatgttgcgagaagtttcggctgaaatttcggctgaaacaacactatgaacaaccccaaaacttcggatccaaagacattgtgaacaatgggggttgtaataatggaaaatacgtgatgatactttcatcatcgaacacaggtcatgtgatattcaagatacaggtcatgtgatactcaagatacaggtcatgtgatactcaacatacaggtcatgtgatactcaagatacaggtacattctgtacgcatgtgacgtaaagactccgctcttgttaatgcttacataacacctgaggaatacccaccaaaaaagcattcaacgccccgcgatacaaaaaggtcgtgcccggaatcgaaccggggttattggaaatcaacagctagtcagaatccaaggtgataaccgctacactacacaaccgttgaggactaggagggtgtattttctatttgaatgagaaaaagtggttttcaaattttttgttagatcgatcttcaagggcggatgcagaaggcacttacaatagtaagcagcaagtaactggtccggtacttggttgggtcagcaccgatctcgcttcggcgtcttgtgtctgtttttttttctgtttttgccttaatagcagagtaacgataccctctgagacagccttcgtaagtaacaacccgaataacagctaatcatatgaatatacagctcatgtgtttcaaaacaatcaatacattcaattatatatcccacccaacatcccatagaatgccttatcccacctccggcattctttccactgtccctggaggatgtgattgaggagaccacaaaacccgagggttcgagcgctttctccctcgtacaaataggtgattgagaacgagggttccaacgctttctccctcacacacgggtgtgattgagaagacagtgccaccagaaggctacagtgttttctccctcacacacgggtgtgattgagaagaccaaataaaccaaaggttccagtgatttctccctcacacacactccaaccatcaacaatccacggcctacggcctcccaccacccctcatcttccacccctcgtcaccttccaactccctcatctgccacctcgtcaccttccaactcccctcatctgccaccactcgtcaccttccagctcccctcaccttccagctcccctcaccttccagctcccctcacctgtcttccatcacccccttccaactcccctcatctatcatccacaacccaccacccctcactatccccactcctgtcttgctaacaagcccccaaatccactcctcccttccaccaccaagagcaccatctcctatgctccaacatcaccagtgccaaaattatcatcgataaaaagtaaaaaagtaaatctcacgaaccggttccgccgaaaacgtgagtgacgctagtctggtttcgtctctgtgcaatcaaattcccctcttgggacgtgaagggtgattgaaagttggtttgaaactgactgggttgtagcgtcgtgtcgaaagacgaaaatcgccagtagacacgggttgtccggggcactccctatgagactctgtccctgagtccatagcatgcttggaacctgggcatggttaacgcacaccctccctgtaaacaaaataaattcctccctgggattgagatgcccccctggagactctggcctgactgtgcctatccgacaccctcggatgacacagtcgtttggctcatagctctttgggaagcacccgtctatgactagcgctacctatggtagtaactagatcgtaggacgcccatctgtgttagtatgttgaagattgtggtggagaagacgtggcattggcaactggggaggaacacttcttgccgctgaaactcggttgaacgatgatcacggtgctggaatcataagacgccagtagtatgttatatgcctgtgtcatttctatatcgtgtttgcgtcatgtttgcgtcgtgtttgcgtcgttgatgtgacgtttttgtgtcactcggtgttgtgtttgtgtcacatggcttgggtgtgaatattaatggtcgaaaaaagttggcggtcatggcgacagtcactgcagttggagcgtgatctacccatgtaacggaacctaggttttccatggtgttttgtgatgttgtgtgatgttttgtaatgtcgtgtgccgagctttttgtgtcccaaacatgcgattttcaccacaacgatgcaaaaaagcccccagtggtgccagccgaacggaacaagacattaatactcactcaagccgcctctttcttagccggcgacaaaaagaagccgtctttttcagtgttcgagacgaaacacgtacttggcggattcttggcgatgatggttaacatgaatagaggattctcaagaatctgtaaattgggggtatatttgtattacacaaacagacaattgagctataggtgatatgcgaccttaaattatggcctgatttttacgtgcggggttcgtatcaagatagattatataaaaccacgaattcgactccattcaactccagctttgacgatgtccactttttgggttcgaagtagtgcatactaaagttttcatctcattagtccctgcattatcaacactaacgtcagaaatacctctcgacgtacgtttatgcccaaagaaataagcttcgtgaaaatggcctgattttcttttaaaagtggcctgattatatggcaagtttatggcattgcaagtttatgggacttaatttaaggttactcaacaatttctttatagtttaaatttactcaacagatttcttgaaaatagtgcaaataacgacatatatccactaaccttcaactagccctataatgatttgtttcaacctgtggagcagttttcgtgtttgtgattcatgtcgtttgtgaagaattaattgggagtttagcgttcttgttcaaatggctaccattgctcaacagaataccgacattctgttaagtaaccttaataaggagttcccctcaattgaggaagggtattctcaggtgagcctatggagtcatatgaccctccaatcatctgaaatactgtagttcctctcatgtatacagtactttatatctagagataatttattttttaatagagtgtctatgttttttgaaggcgatatggtatcaacctagccgtgcagcaccaaaactactttgaatacgataactgttggagatgaactctgtagatcttaggcaatccagcgcctattcttgagtgaatttcctgtagttggagtcggatttgtgacacccgaaagtgaagatgtacgtgagtgaaaacgagaccattggtcctgggaggagttcttacgctgtaacattttatgcatgaatatgaatatgcaagtgtaaggttttatgcacgaatatgcaagtttaattgagtcagtgcctgaagacgaccatgtcgtggggagccgtaatttcgtagcctacgtagtgtataattcacacaagataccacaatcaacaggtaccacaaccaacaacagaggtatttcaccaaagagttccgcaaccaagtgattgataccatgcaacctcaggccgaaatcccagagcaaccccctccgggccacgggccagatgcgatgatacccgcaacaggcgccgttcccgcccgtatttatgccagagttggtaaccgcgacaccgttgacaccgacataaccaagtcgcagctcaacgatagactggttgaagaggctctcagcctgaacatcatcaaggctactgaccggatcaacaaaaatcagctcaagaagctcaagtcaaaggccagaactgtcttgaacaagcttaccaaaattttcgatgagagcaagagtgtcaagtatccctacatggagcaaatggtagagcacattctcttgaaccagatccaaagcattgaaatggatacgaattttgtgactgaggtggctcgagagtgcttggtcaggataatcgcggtgcaaccagactacagggtcatttacggtatgccaagtgttgttcctggaaaggactggcgaagctaactgttggctgaagctctattaggatggcgattctcagaattttcgaaattgcgacttttaactatactgcaagtctggcgcaattttggcccactttttcttctttttttggttctcctgggccgatggtttccattcgaacagtacttgcattactggaaagaagcgtcagacattgaccacatgaggctggggggcgtcgaagggtaaggaaagtggaatctctgagagattccggttttcggaggtctggcagaatccaccgccgcgagcaatcttctgtgaagacaattgagatactagagagatgaggactccctttcccaatcgagtctcacgacgtttctcccaatacccaactgccagaagaagctgagacgaccccgatcctggtagactccaaggaacggaaacgaggctgctctatagggccttgagaggaactttttaccgccccagcgctgcatcacctccagtgcggccctggctttgtaacctccttacaaagtgggtcctccaccggcacgatgtgccaaatggagggggaccaaggctacctcctgctgcgttagtatcgctctagagttttcaatggaatcagcacatgtctcttttactgctcatttgaagtgatccagacacaaagatctagagatcgtgaaaattcgccgttaatcccacctggaatgaatgaaggacttagttgattcccgttcatcctaatatttgaagatgggtcgaaatgatgtcttagaagtgtctagatgatgtcgtacagtgagtagagaaaaggaaaaacaaacaaggccacaacagatcttcggaataaggtaagatggagatatatacagacattgtagataccccaattagctacaattctgtgcatataatgttgtgctcttcaccttaattgtgtgttttgtttgctgttttaccttaataggaagaaaacatacaaaaaataaaagaatcctattcccaacacataatccttattctatatgtaattgtatatattctactgaaaacgtatcaccactattatatataaggttgagataatgcaatgcagtgcatataatcgaaactttgtgaatatgggcgatgagctgtcggtgattgaattactgtagtttcctcctgtttggaaattaatatttacagaatataatgacgttattgagagtttcgtcaaacaaattatcaaattgcagcattttttgaaggcatgatgggtttggggatttttctttaaatacgcgacctgatctgccagagcatgtggtcagaattatagatgccgagttatcattgcaaaaaccaaaaatcaaggaaacgatgtgatacttgtactagtacttataccaaagctcatattaaccagtacaagtaataacaaatgcaccacttttactggttttcccaaaatgtacacaaaaaacatatataggtcggttcagttccatcacacggttaccaatcaacttaggtattgcacattgaaacccacctcgtcatgactagggacgtaatccccgcccccaacggagtcgtcggatatggtccatgacgggaacgaagttcgacgccctccagtgctttatcctgctgcaggaactacaagatattgagcatatcagagctttcatcctcgcacactccaaccaaccacaatacacggtctactgcgttccatcacccccagaatttaattagaaacagcagtgctgagacctatgactgatacgaaccactccacggcatctgggaatgactgcagccaccatagtaggaatgcgctttctgttcttaaagcagtagccaagtggtatcatgagaacaaatgtaagtactgtaccacacatatacttgtacattgaatgtattactctttatagcttactacagaacatgttcgtcgccgcttgactttctctgcggatgctcggattttctgaacaacctgcttctcatccttagacaatccgcgatctgaggtggtatccagcatcttgataacaccttcagcgtaggcaaccatttctgtttcgccggctaaagtactcttctgccatacaaatatggcttgatggatgtccagcccatgcgcttcgataataatgatgcagatatcatgtaattccggtagcatatttcggctgaacgacattaatctgacagcatcatcaatacaacaccacatttgcagctcctggccgtgcaagtacctcaaaatcacttctacagcgctctgaggtagcggtagtagtagcgtattctcctgggctacctttgtgtcagatttcaacttctttcgaaagtagggccaattagctgttaatacagtcttatgagctttaatgttctttccatcctcgctttgaagctgaaaatcagcctcaggcaagtttctgagacgctcaaggccctccatgtagggtgttgtccaggtggtgtgttggatccaaatatcctggtctatcgtcataataaacgaatctttccatccctgtgatagtctcagggagtattcccaattgttgtcgtaaataaaaaaggcattctcagaaatcgccacaaatttgtggttttcaaaagttgtagaaaatactgaacaaagacttgcatgcccctgctgtaacctttcgtcataatgggaaatgtagactctttttttggagggattccgccaataccgcggtcgatccgtcttaatgaagtcgaaccgtcttctgccataatgacactgacctatcgtgcggtctctgatgctcgcttcgtactcggcaggagtcattttgaatatttcccctccaagagattcttcctgtcggctgctagtgttgtttgtgagtgcagtgggacccaatagctcatcaccagctatcatattgctgtgaccctttgctgcaagcgactcagcatgttcgactgcactggcgaaaatctgcacatcgggggccatggagcccatctcccccacaaggatagcttgagggatgttcaaatgagacgctttgatatgattgatgcagattcgctttaattccggcaacaggtacatgtcagcataaagaatgagtctagctgcatcttcaatctccaacttcagccgctggccatacaagtatctcacgatgacttcgacagtgctacgaggtagtggtagcgtcagcttgttctcctgggcctcctgcatgccggagttcaacatcttctcgaaaaacggccagtttagcatcatcacgcttttgtgtaccttgattgcctcttcgtttccttccttgctttcaatgctgaaatcagctccaggtcctcttcgaaggcgttcgagacccttagcatgaacgtttgtgttgcaggtgagcatggcaaagttgcttggattgatttctgttacggtggcctttcctccccatccttgctcaaacactagactgtatcgccaactcgttccagcgagaaagaagacattctctgaaattgcaacagagacaaattcttgtttggaagtcacaaaaacacactggtggcttgagcgtacctgttgcttcttttcgtcgaaatggtagaggaataccgggaattggcctggaatcttcactggctcattactgtaaacaaaatcgaaccgatcattctcgtcaaagcattggctgagtattcttcttctggttttggcttcgtagtcgtctttagatatcttgagtattgtctctctgcgccgtgttcgagttgtgctcattgtggtctagtggagaggagaaggagttatctgtcggcctcaatctctatataactgtagatgtgaatctgatcagtcaagttggccccagataccatcctccaatttacttgggaagttggtttgaggctgtggggttctgcaacagtatatgttactaatcacagccgacctactctacacactcccgcgttagatctccgaggaatgaaacgaaagaaagatagacttgttcttctgtgaaatattacaatgttcaccaattcaagcattttcgagtcgcgtctgactcacgtcgaagtcatctgaatcatctgaatgccatgttgtaaacggcctccactagggtgcggagactcctgacgaatcactctgatagagagaagactttggttatcggaacgcctcccaggaagtgatatgtaagtctttggtgatatataagtcgttagtaatacgttagtgatatatgtcgttaatgatatatagtcgttgatgacatgtaatccttaatgatgtataagtcgttagtgatatacaagttgatatataatcgttaatgatatatagttaagaatatatagtcgttgcagtaatgatatatagtcgctgatgataattagtggttaaagctgtaaatcatttatgattcagtatatttaacctactctgcagcgactgtaaaatctcctgaacgcttcatctctgtacacgatgtgttgctggaaaggaaagagccgctacccgaatacaggtaagaaagtatcccccctctgttcccaggagatatgtgtgtgggagctcgcctgccctcactgccattccagcacgggcctgctctttcatgtggcattttcccagtatgtgggacacgggatgtgcgagccaaatatttggtatacaatttttttgtcttctgcatatacatttatttaaatttgaatttcacaacatgcttagctggacgcagacaaactgaaacttgaactgtaggggtattaggcaacaacccccacgtctttttggtatcaaaatgttcccctagactaggactttctaataatattaatatactgttttcaaaggagctctctaagactcagactggctatgaacgacactgcgtgtagtaaggttccgttgccacaaccttgaccatgatgaaaccgtgaggctgtcggaataagcgggggctgaaatgtatgacgaaaacgggcaaaaagggtgcagatatctggatgagaattgtttcagaattgtgggaggttattcagagttgtgggagatgtttcatactcttcaggggctatcattagccaggtaattttcggcgccggggattctcattagactcactgtgtctctgataacgaaccttgatctgtagatactgtatgatactggacagtgcaatactggacagtacaatactggacagtacaataaccgggagatcgaatcgcaaatgggctggaaaacccctacaattggggcttgtttcaaaaataatggatttctatgtattggggcttgcattttccttcttccccactcttacatgatatcccattgagacagccgcagtaactctgccacaccaccccaccaacaatgtgctggacattgcaaaaaaccaagggaacctcacgggaaaaaaattataaaaggatgagctgggaccccagttcgtctaccagcaacattccctgctacttcaacatctcttcaacatccccttcaatcaccaccccctcaatctctttcgacaatgacacaccaacgtgacaacgacgccgatcgcgacaactctggaaaccccagagaagagtacgccgaggataactctcctgattctcctgactctcctgatcagcccccttcccagagacgctcggaacggggtcgccaaactgaaacgatcccaattattgtcaggcaagaggagaactggggcccagacttttggcgtgatcccccagggactcatttaatgcgcgacacgctgaaaaatcgagccatgttttatagtctcgccagacaaggcttctacccacccatgtgcagatacgaaagaagaaagatgcagcatctagtgcgacctccaacacgcggacttccctactccaaagaacgactcgcggcccttaatgaggctttacgaaaactggaagaccctaatgccgtattcgatcccgacttcgaagccgaccttatcgccgaatatgaaggcgaccttcaagcccaacgtgaagctgtgattagagccgaacagtctgcccgccgtagggcgcggcttgaagtccgtcgtgaagcccaacaagcggaacttgctgccaggcgtgctcgacaggaagcccaccgccagtcgtctcttggagacgcagctccccgttctgcgtacttcgatcagagtgctctggatgccatgtccagagttgcggctggttcttctgccgaagctgaagaatctgctgatgaacggcctgagtcatccggaagaccccgtaaacgtcgaaaaattgccatcgacgatgaagacagcgatgagagaccccatacttggtctggaacgggctgggacgaccaccagaagattgcgcctgacttgcaagaatcaggaggattcccggaccaagacggcgatgatgtgtttctggacgcgtcggatgaatttgacgactctcctgtgtcagcaccagtcgttagcccaagggatttcgagaatttgtatgaagatgactcttccgacgaaccaattgcttcttcttcgcgggatgttcctcgcccttctgctcccttcaatcagactactcacgttggttctgacgtttcccaatctccaagaagatcggttccaaattaccagccccgacctgtgtttgtcaaggagtctgcgcccgatcctgatgggccctctgacagcagctctggcgaggaaagcgacgacaacaacaagcccaaccgggacaaaggcaaggctccagcttccagcagcgacgacatctctgcatctgagtcagatccatcatattcgcctccttcgaaagcccccgcaactactttggaacaacaaaaagttgcttctctggaccgatctgggttggcggaggagtcggtgcccaatccagatgggccctccagcagcagatctggcgaggaaaaccgaacccacgacaccgaaaataacggcagcgtcgtccccaacagctccatcccccaggtacatgatgccgacgaacgctcgaatgcggcgtctcagcctgagcaacccacaccctatttacctggttctgacgttgccgatgacccccgcggctccgaagctagtcttgtccgtggtaccccgactgaccagaacactgcgaacaacgcttctataagattgacgagggaactagagtcacttacacaacagccgaccaagcccaagcccaataccgggaacaacacacgccgtcaaggtacaggaggtaaaggacttgggaaaggaggcgcaaagcgacaccgaaaggttattaaagatgtcattcagggtgttactaagccttctctccgacgaattgcgcgccgtggcggtgtgaaacgaatctccacccagatctacgaggagggccgaactatgctgaaaatctttcttgagaacctcattaaagatgctgtcgcctacaccgagcatgccaagagaaagactgtcacctccctggatgttgtctatgctgccaagcgacggggtcgtcccatttatggctacggttggagcaggtaatacttgtagttgtttttgtaatatgcgataaggaaatatatatgtttgtgaattttcatggcttgtttttgacgtggaaaaagtatcttgtaggtgtctgaagtagacagtagagagccattctggaaaagaggatatagcccagggcggattggttcagagatgaattcttcacatcaatacaatatctccgcgacttgtaaaatcaatcttcagacatgaggtcttttaaggagagagtgatctatttggtgaaggatgtcgggaaaaatggaggtttgttttcagtgatttagacgtgttgttcgcgctattcgttattcgctacttatcatttttcgcttaaatccgccgagttaattaaatccgcttgcgttagtcaagcgacggaaagtttaaaaaaagtttgtggcgaaatgagcttctagaacacgtttcttgcagcatgcgtgtggggaagatgcagaaaggaggcggaaggggccgtttttgtgcaacaaaaagtacataaatctgaagacaacatatctgagaatccattggagcaatttatcgagtcattgcgactatatttgcggtttttcccccctctaaaatgtctggcaggctcttcagaacgttcctgaattttattgtttaaattttaaccgaaaatctaaatccacaactccgtctggaaaactatatccacaactccgtcgggtgaaaaactaaactgtggcggatatgtacaacaccgttacagtacaaatggaaatgtatatatagagaagatgtaggccgttcagactcgatatcagcagaagcagaagcagaagcagcagaagaaacggcagcagaaacggcagcagaaacggcagcagaaacggcagcagaaacggcagcagaaacggcagcagaaacggcagaaacggcagcaacagcagcaacagcggcaacagcagcaacagcagcacattatcatcagcacaattatcatcaccaccactaccaccaccaccaccatgtccctcaatcgatctaaattcaccgagtacaaacaaacggcccgaaacttctgggctggaaaaccccggttcaccgaagaaaactatccttctcttgatggaaagacctttctgatcaccggaggccattcgggagtcggactcgaaagcaccaaactgctcatttccaagggcgctaaggtggtcattgtgggccgcagcaaggataaggcccaggaggtgctcgcggaacttcctagccaacagtacgagttcgtggaggccaacctcgcagacttgaccacaatcaaggctgccggcgagtacattcaaaacaactaccccgagctccagggagtgattctcaatgccggcgtgatgattcccccttactccaagactcctcagggccatgagcttcaatggggcaccaatgtggttggacatcatgctctgatgaagtaccttggtcccattctcatccacaccgccaagagttctcccaagaactccgttcgggtcatttgggtctcttcttccgccaccgtcgtgtctccctacgaaggaggtatcaactttgacgacatcaacttggacaaggtggactcgcctaacgaccatattctctactcgcaatccaagattggcaacgcctaccaggcctatctgtggtcaaaacaccatcccggctctggagtcgtttcagtgtctgtagatcctggcaacctgcgttccaacttgcagcgccacggaaatggcgtgctgttttacgtcctggattactttctgtaccccgccaagtttggagcgtacacggagctgtctgctcttctgaacaccgaggtcagagacacggaccatctgattccctggggccaggtcggacatcttcgaaacgatgttgactactgtcgacgaggtgacaagggcgaggcgttgtggcagcagcttgattcagacgtcaaggattttgttgcaaagctttagttgtgaatagcagacggtgccacgtgtaggagatctgtacttgtaggagatcctcagggcagcatgagacgcgtttggactcagtgcaaataacacccatacaatacattaatgtcgtataatgtaccgataatgaaccgcattgtagtcgttccactctggacttactcatacttgaagtgtcctttctatctacaatgtaggatagaagggcttgctgctaaagacccaggtccaccattgccatctgagattctgagtaaccacctttcggttggccagcaccttctcttcctcggaagtagcaacctcaatccagaccacagtgttctgctccaccttctcgtacaacttgagacggccattctccagcttctttcaggtctcagcgtcctattctctcccactttgcagtctctctctttgcagtctctctctttgaagcctccctttggctccacatagatatgctcgtagggatccgtatcggacaggtagagcatggaccacaggagtattccatgaactcctctgtctgatgtgtttcagtttgacaaggtcaagtaagtagaaagtctcgaccatcattagctgtatctggttggagcggtatcgggctggagatcattgaaagtgattagcgtcagagagtaatatgggtggatacggaagttccctgaagatcgttgttatcgttattgcttgttaatatctcctgaatgtattcagatttatcattatctttcgttccaacatcttccttgttcctcttccttcaccacactcctgttacagtcaccgctcttcttacaatcgcaacatgaacgacacggaaaaactgctgaaaatggcagaagacacgctctgtgaatactcagagagtgccgaacgactagacgccaaacgagagctactgcgccaactacaaactctggccagaaacgtgcacagagaagcggcgccaggcgtggctccctttgtgtcttattccagaccaaagtacgttccaaagtggctcaagcgggatgaagggggaaactgcgggtcctctcgagataccatcggttgttcaagtgagtccagcagtcctagactcggcaacaacactcacccacttggagattccaatccacaagtgatgaaaacaagatatccagacaaagatacagccagagatacagccagaaaaactgtcggagatactaaaattgaaactggaccagagatcaccattgataccaccggaaatgacgagaaccccagttcgactctctctttcaccgataaacagctacgagatcgacagttactaaaacggtttacgggtgcacagctgaagaaacccccggttgagttgtctgctggctggtatcgaccagttagcttgaaagctggtcctctggcccctgccactcgggttatgaaccgactgagtccagtggaagagccgaaactcgatcttcccgtaattcagagagagttgagatgtcgtacggttcgtgtgagggagtctcgaagatgtttgggttataaagggtagtctcatggtagctacagtatcgttctggtcatagctctatagattaggaggtcatatataatcggtgttattcaggagactatcatcgcaattgttggtgaaaagtcaagcagtacttttggtaatgtgcacgtgcaagttctgtacttgtagtaacgcgaattaggccatttttacaatttttctgaaatttcgtttttttctattttttttcatttcgcaatttttctgtattttcatattttttttgtttattttcagtggtttttttgtattttcataatttttttgtatttgttttttttttgttttttttatcacttaattttcgcattttcacaatcattgacacacaaaacaggtaaataaacaaccactttttagttaacttttagttagggttcacagtaaaaaactgccgcttttaaaagggggttttaaccagattttaccccaaccgactctacaaggaccaaaaaaaagaggccattgttgcacggaaaaaagcgatttttgcaagaaaagtactattttcaagaagagacgaggaatttcacatttttccagtcacgtgactttcacattgttctctctggtctcttttccttcgtcttttttttcgccaacattgcaatagagttctcactatgcagatgtgaataatgattcacaactcctacttgacttgtacgagttagccaacaacatgattgacgatattctggccgaaatccggaccaaaacagggtctaccaacgccaccgacccatctggccacagctacaacgcgtctgcggtctcgacgtggtccagatcacccgcgactgacgccgagtctcgagatcagctgcaggccacgtttctggaccccaagccgcagttttccaaccaatggctgcggtacatttccgacgatctgtcggtggacaagacgggctttgtggagtctctttacggcgttcctgaggccacaaaccggtcggacgtccgattcactcgaaaggggatgcggggccatatcagtggctacgaggagttcacgactagcggcgacattctcaactcgaaaaactcgtttgccgtgaaccgggcaaccgggtcgcgactcgatttcgtgcggggccgatcgggattcatgccgttcgcgcccggaggagtggagctggccgagaaggaggagcagagtaacctgctgcacagagacgccgacggcctgtttgacgtgcccccgggctttgagcggggtatgaacacagccacggcggttgcttctgcggacgctgagctcggagagctggctgtgaaggagtcgtcggaagaaacaggaggagaccccgggctcgtgggcgacctgtcgtcgcagatctcgagtatgcagctggcggaggacgtctccaaacacccgatcgacgatctgctgcccaatgatatcactttcggacgggctcaaactgccgtggcccaggcggccaagcagaaggactgggcacatgtggtgaacgtgaacaaggaaatcaccaacttctccgaactggtgccccagccagcccgtgagttcccctttgagctggacacatttcaaaaggaggctgtttaccatctcgaacagggcgactctgtgtttgtggcggctcatacgtcggctggaaagaccgtgattgccgagtacgccattgccatggcccagagaaacatgaccaaggccatctacacctcccctatcaaggcgctgtccaatcagaagttccgagacttcaaatctgaatttgacgacgtgggtattcttactggagatgttcagatcaacgccgaggcgtcttctctgatcatgacgaccgagattctgcgttcgatgctctaccgaggcgctgatctcattcgagacgtggagtttgtgatttttgacgaagtccattacgttaatgacgcagaccggggagtcgtatgggaagaagtcatcatcatgcttcccgagcacgtcaagtttattctgctatctgccaccgtccccaacacgttcgaatttgccaactgggtcggtcgaacaaagcagaaggacatctacgtgattagtacgcccaagcgtcctgttcccctggtacattatcttctctgcaagaacgagatggtcgagattgttgacgagcacaagaaatttctcgaccagggatacaagcaagctgtggagattatggagggtgatgatggtaaggcgaagggtaaagggggtggaaggggaggtcgtggaggacgaggtggacgtggtggacgaggggggagccctccaactggtcctctctcggaccgaggaggtagaggaggtggccgaggtggaagaggaggtaaaggtggtggtgacggaggaggaagaggtggccgtggcggtggaaatggagggggtggaggaaaaggaggattctctcggggtcctccccctcccactaagcaagctttcattcagatggtcaagatgttgcatgagaaagagctgcatcccatgtgtacgttcgtcttctcgcgaaagatgtgtgagcagtttgccggatatctttctggtctggatttctgtaacaagcgcgagaaggctgagattcacatgttcttcgataaggctgtgacgcgactatctcaggtggaccgaaacctgcctcagattttgcagatgcgggagtacctgtctcgaggcattgctgtgcatcacgccggtctgctgcctattgtcaaggaggtggttgaaattctgtttgctcgatcacttgttcgagttttgtttgccacagagacgtttgccatgggtctcaatttgcccacacgaacggtagtgtttgctgggtgccgaaaacacgatggaaccaccttccgggctcttcttcctggagagtacacgcagatggccggccgagctggtcgtcgaggtctcgacaagactggtaccgtcatcatcatggcgtccggagaagttactcccgaggaggacctcaaggagatgatgcttggtcagcccaccaaactgcagtcgcagttccgactaacctacaacatgattctcaacttgttgcgaatcgaggccttgaaggtcgaggagatgatcaaacggtccttctctgagaacgccaaccagttgatgcttcccgagcacgaagccagtgtgaagagccacgaggatctgcttctcaatctcaagaagaagaattatgacgattgcgatcagttcatgcccactattctcgagcttggtcttgagcagcagacgtgtctcaagttcattattgagcagggtcccaaaattgaaaacatgcgtgatattctcaagattggtcgagttgtcattttcaaaaaccccaccggcgctctgcgaatcggttttctggcccgttccgttattggtgaatctgcctccattctcatgttcccttgtgacatttcttcttccaaggccaagatggcagccacactccccatgttccctcaggtggcgggctacaacaagtttctgctggctcccctggctcccatttcgacaaagctagaagcagcttctgttcccgtgtccaccatcgtcttcctctccaagtacatcatcaataatgtctcgggcgtgtctcggtttgatcgtcaggctgttgagcaggcgtacaagagtatccaacagatttgtacgcgtcgaggacccgttcacgagtgcagtttcgacaagctgaagaaactggatctcactgaaaaatgccgcgacaagctggccatgtcggtcgagttttccaagattccctgcatcaagaaactcagtaaaaacttccttcgtgcttacacccaggagtacgaggagtatcaattgaaggagacgattgcaaatcttcgaaagtcgttgaacgacgagaacctggagctgcttcctgactatgagcagcgagtcgaggtgctcaaggatctcaactacgtcgatacaaacaacattgtgttgttgaagggccgggttgcgtgcgaagtcaactctggttttgagctgttcatttccgagctggtgatggacaactttttgggcgattacgagcccgaggagattgtggccctgttgtctgcatttgtctacgagggctctcgggatgtggaggagcctgtttctgtcaccccccggcttgacaagggtcgagagagaatcaaggagctggtggccaacgtcatggatgtgcttgagaagcgtcaggtgattatgacatcggacgagcagcagtttttggaacgtgggcggtttggactcattgaggtggtgtacgagtgggcacgtggcatgactttcgaggccatttccgaactaacttctgcccaggagggtatcattgtgcgagttgtgtctcgtctcgatgaggtttgtcgagaagtcaagtctgccgcgcggatcattggagatgctactttgcaggagaagatggatgttgctcaggagaagatcaagcgggacattattttctgtgcctctttgtatttgtagagaataatgatagttggctttcagaaggtcaatgacttggaggaaataacttgagagtgtacattagtcagttacagtactgtagacgagtagttctttcactttactctttcataatgacgagtttttttatcgatgctgacatctctcggtagcctacttacagtctgaacacttgtctggtctgtcgtagttcaaatggaataactagaatgtagattcaatcaaacgctcgagctgggctttcccggcctcctcatctgttctcaccccgaacaatgtaactgtgtatgctgtagcacatgcactgatatataatggcaacaccgtgatattcgagttcttaactcatgccaatgtcgagaaatctcacatcgcatcaggatacctgtatcgccccgctggcgctcaggagaagcgatctctggccctcctgtcccagatattctgctgcaccaagtgcttcgagcgctctttcggtctgcgacctgccagggtatcaagtcctgcgagtgtcagttccctgacggcttcgcctggacccagaagtgtctttcctgctctcaggcctacccagtatggcatatatgagattgaggatgccattcagaagtgccacctccaggccacctcctccgtcgccccctcccgtggtcatacccgctctttcctaggctctgatctgtccggtggtctgctgcagttctggcacggcaaggatctcggagaagagggacttaggtggctcaagatctacatggccaactttcaaggagcaggcaaggccaactttgtgaggttccttttctacccccgaccctcctcaccccgcttctcttgataacattcttgaagcgattcaacctgatgggcaaccccactgcaagaagacccgtgacaccgttgttgctgacatcaactgctgtgacccggatgccaagtgtctctgtgacaagatcaaggctaccaagtctgccgttggcgccttcaagacggaagtctgagtcgagcgagattaccgagccagttcccatggccgccttgcctccaccagatgtgggactcgaggcctggctggcctgtctggaagctttctgtgacatctacgcctcctttggatatctcaacgtagtcggcttgttcgagaccttttatctcagtaaccagcccagcaactattctgcatcgacgtttcacagatcacctccatgcaaacttccttctgatgaccggagatctgctgtttcattgccgagcgatagggaccccgataccttgccggcgtgtaaacctgtttcgttgttctcggagtcttgaccacctctgcatccacgacgtaccggcactttctgctcgcccaggatctcagcacttggctgggcaaccccatgctgtaccgcacatccattttccaactggttcgatgccaagcgaggcttcaccctgggtattgcggtcgagggctcgtgcctcgtgaatcaaatggccaaggatacagaggagggtcttagctgtatccgagccaagatctccgttgacgccgaaacaagacttcgagaccgatgcaacctcaccctcaccaccgaactggcgacaagtggaagacttgtaacacgcagtatgagtggatgctcaagactgcccatgtgggcttttgctcgtacacagtatcaaacgttagtcactctcaacagtctcgtttctgtcaaaggaattcatgatggactgtgtcgaaattagtcggttcttgccgatcaattggcggacaattgtggaattgcggttttttgtcgccaaaatccatccacttgtttcattacaccacagcatcgaactgtggagtttagtatgttgataaggcacgtcatgcaacattggtatgaactgtatctttttttttttcatgcataatcaatatcaagaataaaatatatatatctatatacaaaaaaaaaatacatacaaaaagaaatagaagaaaaatcaagaaaaatcaagaaaaatcaagaaaaatcaagaaaaatcaactcaatgagggagaagagggagatagcaggccagccacgtaccttcccacactgtcactctgtgtgcacgttaaacatagtgctgttcggactacccccaaattctgttgaaggtaatacccggtggggtaatacctggctaattcctcacataatgatgagaagtcaccacatagtaatgagaggaatcagctgggtcgtagacgagatgtccatcctgtagatagttttatccactgatctagaatctcttttctggtgaatgagcaagcacacacccttctggtgtgtgctactatcggaacgtcgtgtccctagaagtgggttgtaagttgttgattaactatatcacatcaataatacttatgatcttcaataaattcagcgtgggcctggtgtgtgcagctccgaactgtatatttttttaattttaattttcaatattttcagggtgagttccccatctggatcactcgattaaatcagatgaaaaacaaaaagtgatataaaaatatacaaatatacaaaaaaaaatgttaattatcccaaaacccccctcaatcgtatgactatgacttattggactcaccgacgaacgatcggccaatcttcaatccctctttagccttcagtccttccgctggtcttgtccatataagtcactctcttcctatacatcatgcattatatacaacccaccttcgccccagctcgcacacagtccagacattgaactgaacgcacaatgagctccaacgacggctccaacgacgccaacgtcgaaggccggggatctactcgaacacaaaagcgaaaacaaaacagactgcgaaaccggaccaagaaggcggcttcccaacatgaggctggtcaacgggttcccaccagctcatctcatgttcctcttagccgtggagatgctggtttgcctgcctatcccgttctgccctgcccttccaatgtcccgcggtactgagcagcctggaccagacatggcgctgctgggtgaacctgtaagaggtccggctcccacattcaacagcatggaggagtacgaaagctgggtcaacggttctccttccgatgatgatttgacgatggtttctacgatgattacgacaacaatgatgatgatgaagagtccagtcgtggcgatgaacctcgtcctggagctcccggatctgcggaacacaagccgctgggcgccatgatggatctagtgctgagtatgtccagtggacccggtggaatcacgtacgtgggaaaaccgacatggtagaaagacaccatcctcccatggcagaccctcctcgatcgcctcctcggatgagtagcatggaggagtacttggattggatcaataagcctcccgaagaagctgaagaagtggatggtgattgctatgttgatccgacaactcgatatgcgagaaagctcagggcctacgcgagggaattacatgcgtcatgtgaccctgtcaaactcgcaaacaacacttgtttcgacctaggagagagtgtctacgtgaaatctgatattcccttcaagataagtaaacgttaccccaaccccaaccaatcggtgtaccccggtcctgtcctggtcactgcaaaggacggaaacaagaccattacagtttctagaactgctcatagaggataccaaaccgttcccttcagcgatatccagccttgcttcaacggtgtcattccaggatatcccgtggatcctccgagtaagttcgagacgacgacgcggctgcaacgaggagaggctgcttgttgcgtttccattgtcaaggacggagacaagaagacgtactacgtcaactggcagggtttccaccccttctgggtatcatggttccgagaagaggagttcaatcgacaggacttgaaggatattcttgttcggtggaggagattcctgttttcgacaggcagcagcaatctcacatggtgatagtagcaattgatgacgaagctacgagtacagtatgaatatgacagtgatacattactgcctacaagtagcaacaacgacacaaattgtagatcaaaggttgacacgaagaaacattgaacaaaaagatacagaaagtagacacaaccaacgttcaacaaaaagaaatcactccgatacggggaatcgaaccccggtctccacggttctcaacatgagagcgtgatgtgatagcccctacactatatcggacttgtaaggtaaaaagggcgttgaaactttttcactacaaaaatgaaaaaagcacccatggaattaaaaaaaaaaaccatgaatcattagaataaaaaaaaaacaagtaatgaatcattagaataaaaaaaaccaaagcttttagccatgattcactcccacgagaccacgagattgacaagaacaagacgaaacgtcgacaaaccaactgacatgcgcctcgagcccacatcgaaatgattactaagtgaaaggaggaaatgacgtaatcaaggactgcggacttgtataagactactgaccctgggtcctgctagctctatacgctatataaatagttctagtggatcattagattgataataattgaaaagtaaccgccaacagtccaaagaatgagaatcgggaacctttaagggatgttggcatcctacaactcgattgagaccatttcaagaccatattcaactcaattgaggccattttcatgatcatctcgttaagaccattcccattatcatctcttcatctagatcgccattgagaatcagtacgaagaatgtgttggaatcaagttttggctgcgctacggtagtgcagttcaactaggtattgttgaggttcgaagagagatcaacgagttctctcatgtacttctacaagtacgagtattgtacccatagccccgtgtctcttgtcctacagtaaccctcaaacttgggctcagatgttaacaaaaataatatgaatactatatacaatctaagagaaaaagtagggagaaaccaacacctgcttaaggtccaggtctcccttttttggggggttgtcgatttgaaacttggtcaaaaaccgcttcttctggtcaccattatcggtctctacctgcttggtgatcatctttccgcccactcgctcggtcaccgtctggatggccagatacttgtcaagaggccgatgtttctccagaatctcgacagttgaggggttttccagtgcctgctttcgttcggcgggggttccattgctgagctttcggaacttgagatcctcctgcagctggtcgaaaatgtggttcttcttggagtccctgtcggcgagctgcttgccgagctctgtgccgtcagtgataagatcgacccgcgagtagaacgagccgtaccgcatctgcagctccttttgcaggttgccaacaatgtccatcgaatgcagcttcacaaactgctctcgcagcaccttgttcatatgagggacgtcagctgcgtgcgtccagtatgagtcgtgcaccgaggcaaacgacacatctttgtcgaggttcagagcagtcagcagcatgtgcgaggcgtccagagaatgcacaaagttgggggggaaggcctgggcctgctttcgagattgaacaccatagagagtaaaggcgtcctgcagaaacacagactggagcgcagtgtcaaactgacgcttagcggcctttctgtagggctgaaccacaggcagaccaatgggagatgtccagatgacggacgagagcgactcgcccgaatggatctcctgcaagttcgctgacggtcgcacagtcttggtgatgtttctggcacactcggtgagccaatcctgaatgtcatgggcgtttgtgaagagcgaacgcatggccgaaaagacccgctgggccaggtaatgggccatttcatcaatctgagccacatcgccgtactgttccttgagctgggtctggatctgagccttggcaccgataaaagttactccgtagacgtttgtcatgacggtgggcttgacaatctttcggttgattttcccaacaaggaagtccgccaaggggttgccattctcggcgtcttccttgaccagctccgacacaatggaagccacttcggcgtacacgtcctggggcttgtcaaacggcgtcaggttgacttgtcgagctccgtcaatatctcctcctagggctgcgtaatgctgtagtccgttgcaagagccgtcttgctgcacaggaatgtgcgagacaaacttggaggggtctggcaggtcgtatgccgcaacaagctcgtaggatgcggccagaaactgccatgggtaatcggcctctcgccagatgctgttttcctccgcgagggggttctcgacggccgctcggatcttggccatgttgtcttcggtgaacttgactcggtcatcaaagttggccttgcctgctccgtgcaagttggccatgtggatcttgagccacctgagtccctcttctccgagctccttgccatgccagaactgcagcagaccacgcgacagatcggagcccaggtggttaaagtgaggagagagcgggtatgctctgcctcggaagtccacgttgtgagggaaatgcaacttttcaccgagatgggctcgggcaatctccagcttgtagttggagtcacatcgcacagagtggtccgacttacgcttgttgaggataacggtgcacatctttcgccattcgcttcgagccacggggtcgttgtgttcgggacactccgggagcgagttgtccgtgttgacggcgggaatgtcaagataggcctctccagtgttccacaccttgctcatgatatcaaacaccttggagttgacggtccaggcggtggagccgagcttgttgagaccggcaaagagacggtccaggtcacctcgctcagaggcagtgtccaggtaggccgtctgctcggaggactctcgtgctcgcatgacagacgcctgcgagacgtagtaaccgccagtcttccaggccacccacggcttgggctcggccagcatcggcagaaactgcggcgtcacaaacgcctccgaggactcggcaccaatgtccgtgctgatcaccttttggatcatcaggtcatgcatacgcaccatgccgagtcgctgtcgcttgacaagctggtacgagtgacaaaagacgggcacgtctgcggtcacagaggcgccggtgacaggatccttggctgtgacaggcattcgagcaaccttgatgagaatgtccacaagtagagctccaaccttggcacgcacgtcgatggcccacgcaggcacggtatcctccagatcctcggcatggatcatttccatcaccttgagacgtcgcttgagacctgtgagcttcttcagaaaggttctcttcttgccgagtttctcggaccactgagaacatcggtactcaatctccagagcctggccgacagaggtgaccaggttggtggtcttgactccgctctcgaccgatcgcccgacggtggtctggagacgcatcatctcaataatggtgacaatggacatagtcttgggcgacatgagcttcaggtaagggtacaggtcggtgttgatctcggtctcgccggcctttttgatttcctcctgcacaagaggaatcatctgctcctgccagctgtgcatttgttcctggaacttggacattcctgtaaactgctgagactggctggctttggctgcccagagctctccagcagcctcgattcctcgcatctcaatgtccagctgtctggcctggttgagttgttcgagtcgctgttcaaaatcagcccggttttccgtactcaacgagttcttgatgttgaacaatgaaatcttcttcgacgggtccagcaggtccttggggatctcgtcgtagtagggcaagttttggataaactggtcgactcgcacgtctccatccacctgtaaaagcaggtttttgacaatctcaatgcccaccacctcttctccttccttcgtatgtgtttcaatcttctccgagcctcgcaggttactcttgagctcggcggagatttcctcccgcgtcttcttcacctccggggcggcttcttccttcaatgcctccccggtgagctcctcgaaaagctccatgtacgcctctccaaactcggcaaagttgtaattgtgctgtttgagcacattcagcaccttgggcagccgctccagaccaacaatctggatctcctccaccaccagcgatgcgctcagcttgtggtacagctttttgaacagcagctccgcaatctgctcctcagactcctcgtccacaatctttgccagcagatgcgcgtacatctgggcatcgggtcgcacgcccaggttgtcctccatcgtcatgagccacttggtcgacttgtccaccgagttggccttgatgtatgcctgggccagctctcgggcacagagtcggattcggtcgggccgccagatcttggcatgggccaggttggccacaaacgactcggcccgcgaaatctggccggccttgatggctgcgtcaatcagaccccacaggttgtggtcaatcttgaactgcgagggcgtgaagtagatttcgtcgtggggagacgaccacgagtccgacgagccggggagctcgctgtccacagctcgcgagaacagagagcccgactgtcggtctctggtgccgagacgcatgggtttgggcaggtcgttctgaaacgccttgaggttggatttcttgagcacgccgagacggtccagctctttaggcgcatgcagatggtcgtacttgggcttgccggagtggtttcccatcgagtccagcatggagtagttggagaagtccaagggatccgagtacgtgtctgtggcgactccccggggcgagtggcgtgggggagttagaattggtcgcgacgcggcggtgtgaatttttcgcagcgttcgtaatcgtagcactgggttagaagtgttcaagggggtggtggaatgtgagtaagtctgaatagacattggtaggtagagggcggtagagggccgccataggtccagtacagtgaccggcacatgtccagcgactgaaaaccaaatgcagactagtcctctgtgccacattctaggcggacacacaaacaatatcaatgtactgtatctgtaagccctttttgatggccagcctgtatgaatagtatggcatgtgtgaacagtacgacatgactaatccagaacagaagtcctcaaccgaatgtctcgactaacagtcactttacgactcagcctgtgaccgtaaataccagctggtaccaacctcatttcatcgtccacctcatcctctaccctatctcatccacaccaaatctccacctcagctcatcctccacacatactcactgttagtaatatgtacagtcgttagcaaatgatatatgtagtagttgaagtgattatcgtcgttcctcctcctcgtgtcgtcgtcgtagtgttgtttgtgttttttttctcgtcgatggtgcgaatttgtatcaatgtatgagctccctctctcgagccgttacagtgacaaaaaaaacactcggtcctttttgcttggttactatgcaccatatttcaaactcagtcctggagaaaacttttgccaaacttttcactgttgcatctctaatgcgctatcgtgtgacttatcgcagcagcggtagtggccgatggggaccttttttcgagataaaaacgggctcaagtgatcgtaacggcctagaagtttggatttacgtcctaaaaatcgattttcggtcgctttttcacccatttaggtacacccaaattttcacacaaccgagcccaaaaacgtttactcaaaagtcactcgatcaccgatacggctttgggttggggttgttagggttagggtttgttccggatggtgcgttgtgggttagggttttattgtggcgaacatgtggaatattcgatgcgatgtggtggttgacggtgttgttggtggtgatgttagtgttgttggtcgctgtaaattataagtgtttttgaggtataatcaacttatcctcaattgattttgttaattcccatgtattcccatttattcccatttatttccatttattcccatttattcccatttattccatttattcccatttattcccatttattcccatttattcccatttattcccatttattcccatttattcccatttattcccatttattcccatttattcccatttattcccatttattcccatttattcccatttattcccatttattcccactttaattgatatcctcttttcactctcaaccccatcttgtcctatctctccatatctcccacatctccattgttcatgtcgccttaactataccataagtttgtcgaaattttcttgtccattgagcaccattttttccttcttttttctcttttttctcgctgtttttcctttttgctctttttgccacaagccctcaatatttccacatttattctttcattttgggaacaaaaatacaacctcaaatacagcacaaatgttattctggatggttcgagcacttgtacaaaatggggctgtcatttttggatatttttatttatttatttatttattttttcatattcaactcacgtgttgacggaatttcgaaaaatagtcgccctattttggtttaaacattttcactgttttattttatttttattcttcttttttttttattcttctttttatttctattttttcctacttttcacatcccccctaaccccctcctgccatagtacagcgctagcgtcctgtggtaaaatggaccctacagtgcagcacagacgctggtaatatcattacactccgccattaattagcacttaacctgtctctcctcccaacctggtgcgcatctttttgcaggtataaaacttgtgtgtcatcatcaccatcggctcttactctcctcttctcctcaccatcactttccccaacaccaaaaacaccaaaaacaccaaaaacaaacacaccacacaaaccaccacaaaacatctgcatgatgggctccgtggtaccgctcagttcgcccgcttgggacctcaatctgtccgcgggacaaaacctcctgggccatggctcgcccaccccctcacacagccgcaaacgccgtctgtcggtgactccggaagccggcgacagccacatggagcacgagtcaccttccaagccacgtcagcagtcgccgtttgtacacaagcgggcgcgggtcacacggcaactgcagtcacggccgctgcccatgtcgcggctgctgtcgtcgctggaccagaagacgctggtgtcgctgctggagggcatctgtgctcaggacgaccgggtggcgcgccaggtgatggaagtgacgcccaagcccacagtttcgtcggccatggacgttctgtcgcgagcgctcgaccaggcgtttgcattgttcccctacaagggcgaccaccagaacgactacgccttcttccgggtgcgtccggcgctggaggagttcctggccgagctcagcgactacctgtcacactttctgccgcccaacgaaacccaggtgtccaactcctttgcatttctggaccaggccacgtcgctggtgcaccgcatgccccagtggtccagccccgccaacaaccgcctcaaggaagagacgtacgaacacattgacgtggcatggaccctggtgtgcgaggaggccgccaagcgccagagaggctcactggccatgtccggtgtgggcaactggctcatccggctcgaaaaacacaacgagctgtcgggcgaccgtctcaagacgtcgctgcatctcctcagggacatgcttgacgaccagggctaccggccccccaacccctttgcttcattcaacggcgcccagcagcttttcacggtctaacgaagatacacaagcaccacatatttattgcattacacggtctacaggaatggctaggatatatataggaaagaattatgagaacatgtagtgggtagttttgtagtgagtagttttggtagtgtttggaggttgcctattgtgtggcaaatttctgcgacatttgagatgcgggtgagtggtagtacggtaaagagtgagtgggagtaggagtgcgattcgatttgacatatgagtgtacaataggaatgtacgataggggcgtagatacaagtacaatgcgagtatctgtatgatatgagtgtctgtacgatacaagtgctgtattgtactgggtcgtacatactgtatcgtacttggttgcttgtagcatgatcattcagtatctacaagtataagtacttggcttactctcatacttatactaggatacatcttacacgacactttttcttcactctgtttttgccggttccttcctccagacactccaacgatgcctctgcggatctcgtgatcccgtgattggttactcgtccagaattcgatgtccttttagcaccgggtggattggtgccgggctggcttggttctcggctcaactcggctcaagttggttgtcggtctcgacttggttcgacttagttcgacttggtacaactcggttcgtgactgttcattaaacgtggcatgttgttggaagaaacgaacagacctggggccgatatggcattactgtgaagagtacagttgtgaagaagtcgtgcgacagtttcgagtcatgtctgactgctgcaacttccacgcacatttggagcgtggcattcgtttcttgtcgtgtctcgggattgacgcttttgtcattgttcgatctttttctcctccggatcgtccgctagatcgttggcaagagttcgccctctggcactttcgactccatcgtcggggtgccagactggtgatggctggatgatccaggactgggggcagcggttgagttgctaagaaactggactgaaccagagtgtggaccagaaatgatactggagccgactagagactggacacgaaaggatacgagatggatccgactgtcgactccgacacccacgaaagcgagatatcagaggcatgttcccactgaccgctgctaaagacttggttgtcccccactcatgagtaactggagatgatgaacgcaccacccccaccgaatcaaacaaggtccgagagtgaaacggaaagctgctcactgactggagggacggttataggggtcctcatacggctgcttcttctgccatgattacgaggtctccacgatgatatcgtcaacctcgtaagatgagaaacttcgactagtggatgactgtatggagatttcccctgtgatcaaactgttccaatagccaggaacctctcgagtttaccctacaaatcctgcttccactgtcatcgatgcacatcaaaggatacaaaggtgtctgaagctcctgtcaaatgtcaaatgagatcgtggggtcttgggtcagtgtcgtttggcaaagtccatcttcaagtacgtgtggaccaagagactttgttcagagagcatctagaccaaataatacccttccagagacaacttgatcccctcaactttcggactgtcgtatccgagggacaaggacaagtccggtgcgagctgaaagtcgaccaagacttcgcttagcgtctggagataattatcattgacacaaacctggacctcgcatccaacaaacattgtgagaactgcgggtgaagttcttgcttctaggtaagttactcttttcacaacatttcttcgaaatcacagctgccagcaattccagctttaactgtctgcaaaatgaccaaagctatacgatcaagcgccatgtctgccttctctcctgcttgatcttgtctttctgcgactacagtacaactactacacactcttgtcgtactcggcagactctcgttgaagagtaacagcaccttagagcttccccctctctacagatgctcgcactagaacagtgagaggtcaaaagttgatgaaccattagacctgcttcaacggagattgacaagaagacgaaaggatttagaacacttgtccatgactgaatctccaacaccctatactctacaattagggagagataactcatcctgaagagatgtccgaccaaatatggatacggtcctaggaacatgtctcaggatcagtataatggacgaaggagaatgggcttgaagaaggcgaactggtcaagtcggaacttgcactgtgtacttggtggtagagacttagttgggggtagagcttggttacttgttggtggagattgggtacggtacagtaggtacttggtagtagaacttgggtgcttgttggtagactggatacttggttgaactaaagcaccaagagtgccaaaagagtgctgaaacgcgaacgccataccgcacctcggcaccaacccaccacctacagttcacggataaaaatacacatacatcattatggatacatcaattggcaggtcccggcatctactgcaggtaaagatgtcgcttggcagccatctcaacggcagcagctccccagtcctctccgtggttgtgtccatcaggagtgagaccagctcgctgaagagcctgctcctcggtcagacaggtgagcacgccgaaaatgacgggggtcttggtggcgatctgggattgcatgaggccctgggaaacggcgtcggcaatgtactcaaagtgcatggtggagcccttgatgagcacgccgatggagatgacagcgtcgtacttgtgcgagtctgccatcaggtgggtgatgtagggcagctcgtacgagccgggcacagactcgatgaaaatgttctctcgcttgaccttgaagccgcacagagaagagatggttccgtcgagcagagccttgatcacctgctcgttccatcgcgcgtgcacaatggcgatcttgaagtcggagccgtcgtaaatggcgtcagaagcgccaacacccttaatagtacagtcggtcattttcagttggtacaaagtgctgtgtgtgagtgtgtgttttgggggtggtgatgatgatacagggagatctgggccaacccaattgtaaccgcgtctgctgcatgactgacaaatacccgggagtttgattagtcatccaaaacggccccgaaaacggccatttttccgcccaaccctgtgtttgggctccaatggccaataaacgagtcggatttttcggtctttcctctctcacacgctcagaaccacgattatcgctatcgactgtttttttcagctcccatttttgtctcagggttaggttcgagacattcgtttagcctcggtcctatgatcatcagactcaattacagtaatctcagagataagaaagagcaactgagagcgtgctagctgttgtcgcgcgccgctcaggctccaaatggctgagtaagccatctcagccgttttctcggaccattccacccggccttacccgcgaaacttcatgctccaacatggaacactcttggcagattgtcccggcctccaccaaacacgacaaatgtacgcccagcctcgccggacattgtcatgaaactcaatccaacaatgccatagttcggtatcttcccgtggccttctttctgtggcgatggctgactggcggcagcaagtcggagacgagacctgcgcatacgataccgtacagcatgcaccagactctgtacggtgcaataccggctctgtacggtgcaataccggctctgtacggtgcaatacggctttgtatgtacggttttgaagagactgaaacagcgccggttcagggactctgggtacaatgagacatgttgcagtgtttggggtttgaaacgagttgcgacatagtacgagtacgagcacaagtgcacatttgctccaagttcttgtacaagtacaaacttgtaggacgtgaatgtcgatctaactgcgggaaacgtatcgtggcaacggctcagcttgtatagtgtatgatacctggatgtaccggtacaactatgtactgaccagactgttcatcttcaccacagcaaaatgagattgcacacatccttcagaatgaaacaatcagttgacatctctggcattcacattcaaaagcgcatatatggacaccagctcggagtcaggtcacgtgaccagcaaccttgtagagccgttctgttattatacaaaaaaattaaaaaattaaaaattaaaaaaattaaaaaaattaaaaaaattaaaaaaattaaaaaaaatgcgaggtgaaatattcgggggaaataaagtttttgtcaggtgaaattcagaaaaacgaatcaactgagctcaccggttcgtacgtcggttgagagtgttgctaacgactctggaagtcacagatgactgtttttcgaagtgatcatcatatcatcgtatcaactttggcacatgttggatccgttcggggaaccccatctggtaaccttattttcaatatatctccgttatcaatggggagtagagatattgtaaatctaacaacattttggtatttgccaggaggttaggattattttgataccaattttggaccaaatcgtcagaccgttgtatatccagcgccatttctaccgtaatgtcgtatgtaaaacacgtccctaacccccgacgttgaattaccttgaaaaacctgacccaacaggctgatttgcatatctactacagtagttggacgccaccagctccgtggtcatgctgactaatcaaaaagccaaaacccacatcaaccttatcaaaatatttttttcaggctgcaggaaaatctcgactattacgcacaagatacacaacaacaaccatgagcgaaatcaagacagtgaccgtggagaagcccgtgcccgtgacgtacgatctgggcaaccttgcagtattcgacacaaatcccgtggaggtggatctaaacgacctgaacgtggacggccaggcccgagaggaggctctccaagccgtgtctcgagataatgcccagctgctcatcaaccagcttctgtcacaacccatcaagaacaccacggactctaattcgtccagcggcaaccagaactccaccatgtctctgatcatgctgccacagccgtccacacgtctccctcgagagaagcccattcccaagcccaaggccatgaccaagtggcaagagtttgctctcaagaagggcatcaagtccaaggcccgggatggcaagcttgtgtacgacgaggccaccggcaagtgggtgcccaagtggggtttcaacggaaagaacaaggagctcgaccagcagtggtgtgttgaggtggacgatggtaagggatccaagaagaaccaggaggacgttatgctcgatcctcgagctctggaccgagcttctcgaaagaagctggtcaagaagaaccagaagcagcatgagcgaaacctcaagcggggcgtttcgaaataggtggaaaaatagactaattatattttgatcattaagcgggtatgcgatagcagttgtttggtggatgtaacgtacttgtacaagttcaatgcagtagttatgactgatctagcggtgtatgttgtcgtagttcaacctctgtgactgaggttagttctatcgagtgtagttgactgggactgacgactggagatgttgctaatgcttgaacgttgactgcgagtgcgagtacagtacggatactttgcacaatagatgtatagcccactcgagtcgattgtagcagtcatctgtctcgtaaactgctggagaccatccaaacatgcatctctcaatccagaagtaacagaatagcacgaacacgaacagtacgaacagtaccgatactggaaatcgtgtttgttggtaacgtctgggattgatactccgatcaaacgccgttatccggtagttcaaatcacttggtcggcgttctgtgcaaaactgcttgtgctgtacaacatacttatcatctgatagttccacacagtggaaggggtgaatgtggattctgacaagaccattcacatgattgtttttccatagaatagttatctttcatctccgaagacatgtcccatggagaatggtaggctgagttctgggtgagagagaaagacatccagatctaccgtaattctttaaatgttgagatcattttaattaataggttttactctggaaataaatctttatcctgtcaattttcagcccttttcttcgttttttctccgaatttcctcacttttcccatttattccaatttcccaacctgatcatatattttttccaatctccaccaattttttgatccaatttttagtccacaatgacccaataatggcctaacaatggcctaaaaaggaccccacgacccaataatgacccaataatgacctaaaaatgacctaaaaatgacctaaaaatgacctaaaaatgacccaataatctaactgtacctcccaattgtggatgtactgtaaagcagtgcacaagcgacaacaaaacacctaatgaccacacaaaacaggctagaatcgcgactagaggaccgttttccgtcaaatttcgagcacagaaccaaccgagtatttccaacgccaccaaaaaccaacatgtcctaaaatattacgaaaaacaacggcggaaatcactgctgatacccagacgaaccccgcatatttttttattttttttctgcatatacatttttttttctgcatatacattcatttaattataactttgctgtgaaagaataacctttgaaatgaatgtacgcttacacgaatattactaattaaacacgcttagtgtcatggtccaacttggcacgtacctatttccagtaaaaaaatcataaaaaaacctggttcagtccgtgttgtatgttggtccacatagcttcgcgtgtttgttcgttcatcgggaaaacgccactccagtctccagttctctaatctcaatccttccattgccctcttcgtttgcattgcctttgaaaacgtctccttgtggttcttcttcgtcattggtttggttctgcgtcccctgtgatgactacgcgccctgctacgctgttctctcggtggcctcggccgccttttacgcttgctactgtctctactctcgctcatcttgaagtgctggcggttgtccatcgtagaaacacatctgggcttccttcaggaattgaagcaaaccctgttggacatgtcccagggtggcgtcgtcccctgagtaccggagggatctctccatcttccagatcccataagccaattcccgcagatatttgcgtgtcttggcatatattggaatgttttagtttgggatgtgtaaataaatacaataatagccttttcgagcttcaatggtagatgtataattgaggagattggacgctgcaaatggacggaaaaaggaaatttcgagctacaaataacgctgaaactggttatgtaagctatatgcgtcgtttgtctgtcatattcctgtctcaatgatctgttttcacgacgttatcgtcctgcccccattttaatacccaaacaaagacccgaacccaatactttattcaccacagcctttcgaatataaataggcgtccagtcccagttttttggcggcacctttgaccacgcgtgtcatcgtgtcccttgggggcaacccctccattgaaccctgcgaaagcagttttttttttttgattcgcatccgaaatcaacagaccggctccggccaaccccagaaacggctccggccaaccccagaaacggctccggccacgaaccccaagaaacggctccggccacaaaccccaagaaacggctccggccaaccccagaaacggctccggccaaccccagaaacggctccggccacgaaccccaagaaacggctccggccacaaaccccaagaaacggctccggccaaccccagaaacggctccggccaaccccagaaacggctccggccacgaaccccaagaaacggctccggccatgaaccccaagaaacggctccggccatgaaccccaagaaacggctccggccacgaaccccaagaaacggctccggccacaaacccgatagtcattcagttgatctgtcaaaacgataggtgtgagcgctacctcaaaagccaaaaatcgctaccaagtgcaagttaagatgtggttgaaagctcggtgattaagtcttcgatcaggtttctaggtgtcctgttaaaaccctaggatgattttagttgtcaacgtcttgaaatgcggctgtcctgatgagactacgtgattatgactagcgtcgaaacactaccatcgagagaagatggtggtgtagacagcccctagtcttacatagtaatatattgtacgagtaccagttccaaagtacaagtagttcactcggttttgttctgaaattgtataattcagagtcgtgcagacaagtgcatcattgcataactaagaactcgaactgtttctacactccatgggttttgccttgaactcgcaatatcagatatccgccctttcacatctcgttgatatggctccgttgacccgtataatatccaatacaatcgtgtttcacatcatgtacagtacatacccctattatacaacgaatgacaataaataaataaataaaaaggtctaaggactatgcagtcgcctcctcgggttccttgcccttatcttgaggaatggcaggaagaggagcctttttgtactcgcgaagaacagcagtagtgacggttccattgagcatcaccgcctgaccaacaatagcaacatcgccgtcaatgttgatggtctcagcaataggagacttgggctcgatctggctctcggtggtgctggtggagaccacagaagtgcattttcgccgacgcgagtgatccgaatggtcctccgcatcagtatgctccatgtcagtgttctccgagaactcaaacgaagatctgggcggagacgcagaagtggcagaatcatcttccacgtcactgtccacatctccaatgcctcctccgcagtacatgataccattgatctggttttcaagagactcgtcagaaatgttgtcgtgagagtacattcgagaaggaaagaggccagcgggatagctggatgaggtaggagacacggcctcttgacggcggacctcgatagcctcgtatgtgtagacgccgttaccctccatgccataccaaagttcaggggtatgtttgaccagagtttcaagcacagacgatctaattctaagagagggggccaaaatgcgggctagcgtcgacagcgtcattttgttggtctcgtggtggttggacacgtcctggatgtgtgtacacagagtcctcagtacaacaatggactgtttgggcagctttccgagcgcagtcttgaccacagataccagcaccttgggctgtgtctcctggtaggggttggggaagaggtcgtcaggcagttgtcgtagaaagttcttgagaaacgaggttagagtgtgaacatcgtagtcgcccaagtcacataggggcccgttgtcggtgaagcatcttcggagctgttcgattttctgggcgctggcattcagcttgtagaccccgatctcggtgagattgttgttgatctcgcgaatgcatcgaaacagcaccagaggaaggtactccaggtctcgggtggcgcagatctggtggacaatcttcttttcctccacggttttgcagccgtagccgtactggcgtctgtaggagctgtcgaggctgctcagcttgaccaaggacaggcccgtgtagtagtagttggggtttgagggggcgactgagcatcttgaggatctggacgatcgggtcgaggtgggtctgagtgagtggaggggcagttctgagtgtgttgacagtctggaggaagctgaagtttgggggcgagacgaggaggtggagggtcgtctggaggaagcaatggaggcagttgaggaggacgagggcggtctcttggacttgtgtcttttctctgccagatcgccttccccgatgaggaagagcagttcctgtttggccttttctttctggatctctgcttccagcacctttttgtctcgtttgaagcagtcgtcgattcgggtggggtccatgggcaccgagattggggtgctcttgtctatggacgaggagccttttttgctgaacattcggttgagcgagaaccgcttgggctgcgtcactggggacgaggagatcatggtgacgggctgggtggacatggcttccacgtcggtgtacttgaagtcgaagctgagcaccgatgtgcgtttgtcgggggctttagtagtgatgaacatggcgattgatcggaagagggcgctttaagatagagtgagagttatctgtgaccgtcggcagggctttgaccacgatccagggcgattccggatgcgtcagggtccgtctttgttgtgcaaaaaaaggggtaggagcttagacaccaccgactatttatcttcttgtgcgaccgcgggcctggatgacagatggggcaagcgcacgctcggggcgtcacatggtctcccggcccgtaataagtcgttgatggcggccaaatcgagccacaaagatgtgcaaccaagctgccacaaccaccttctcatgtcaccacacaaggccatactgtttttttcttttttttttgataaagttaatttggcagtgtactgctgtagtccaacctactttccccttagcgagggttattttagtcgtacatgtgcgcactttatatattatgaaaccgtgtgtggggcccgtgtcgatcgcgcaacgtgattgaggggacatggggcgatattttgggggcgtaatttcagccgggctgcggcggggcggggacaatggtcggccagaggcgggacgtcatcggcacggctagtgcgagcggtggctgtcaagtcccagtttggctgcttcaattagtatcaccaaaagaggaatggtctaaagtagttgtggttgcgagctgtggttcaggttcagcggcgtgtgtgttgatcttatggcatggtgggttgtcttgtctcactcaactgaggtagtaaggcccttgacagtttgctcaaggggcaatctcgatcagctggtggttacggttggaagtcagaggttcttacggctggaagttgttacggttggaaccgcctggtacaacacccattgtcttagtctcagacgtccagacgtctcagggtggtgcttcctaaccacttccaggaccctgcaaactaacagacgcccacgagccctgccattgtcacggctaatctagctgcagcgggtgtttggagcagcagcagctggcactagtgcgctctgcaacagcgtcgcaaaccgcagcgacgcatccgtccatctacccacactcttccggaacgctacatagacataggcttgggatttgcagcgatcaaacactacttgtaggagccaggggcatgtgccgtgcctgaggaatgaaaacaatgtccacactcatttggcaaacactcggacaatgaaatgtcatgcactatcgggacgctttccaaagagcagccgttgctgtacgagtacgtcacatgcggcggaatctgggcaatggaagccactccagacgacagcgtaacatcatgaccccgatgtatgtactaactgtaccttagctgggtgttattcaacgttatcacgcctttgggaagggccatgtctaacgcagtccccgaactagcccacccaacttcacgttccagcacgtaaatggagttattctggagttattctggacttgttctggagagatcagcgtcaagtgcccgcatgcgtcactcatggaccttccagggatctgagctaacgaaatattggttcttggcaatggtgataatgcagctgcgggttctgatacaggtagagcatcggttcaagtgcgataccgccttttttgctacttgttgagaccatttatacaagccaggggaccagggggtctctttcaagctgggttgcggcttgataatcccctacaagcccgagatatcgtcccttggcttccgtattcggctgcagactctgacgtttgacgtttgacgttcgacagtactacaattagtatcacggacatgtgccaaacaggacatcgctgttttcagacaaccggtcaagtttccatttgccatttcatgtggatactgatctgccacggtcgtcagtgtctcacctacaagtagaacaagacatggttgtgagacggtggtaaggaggccttatcgtggggccgtgagacggtgagaatgaggtttcacgtcagaatcgatcccggtgacagtctgtagagtctgggtctgagtatcgtatgaatcaatacaagtgacagtcaattcagttctacttgtagtacatagttgtatttcggtgttcaggtttctgccgtattaccacaagcacaatatatatgtacataccataccacagccacatgcttggccctcagtctcggtgatttgagcccattttaggaaacatttggttgtattatcgctcaatctcatggtacgagtactatcattcgatctcatattcgcaactcccgtattttcctggttttcttgttttcttgttttcaggttttcaggttttcgttttttctggttttcgttttttctggttttcgttttttctggttttcgttttttctggttttagtctttttttacggaataattctccaactcacttaaccccgccagtaaacactggttaaaaaacctttgcatttcatcgggtcttcgaaagaatggagcccgacagaaaaatagcccaaatttcccaccttatacgctctagacttacaagacaacttgtgagaaaaatatcataaaatacattgtacaatttttgtgagaagaggcaggaaaggatgagtataagatgttggtgagaaaggtataaccctgactaaccaagctgtctgtgtcaccgaagcagaagcagtctgtgcctacgaaccacttctgcactctcactctcactctgactgtctgacacatttaattaccataacactcaatcaattcccctcaccgtacagcatgtaattggatatcgcgatattatcaccgtgaaaggctgtattttcgattctaggcaataatatcgggtctaatttggtataactcgtctccaagtacctacttgtatgtacttgtaggtatattatcatgtttgattggactggcagtatcgtatttattgtagttaaagactacagtaattatatacaatatctactgtacatattgtagatataatacgaagctcacaagtcatgttcgattatccatcgattgccaaagtgctcctataattacggtaataactgaattactatcgagatgttgacacctctttactcgattgaaccatgtacatacagtgcatactggaccaatatctctccactcgtcgtcacctctcgattggtccaatatcccctcctcacctttgactataaaaaatacattatctatcacatactctcaatcgcatacgcatctgaaagtcttttagttcccggaccaatctactgctctccaatgtccatctcgtctcgtcgtctcttcttgtcaaacttgcttcgcttcttagttccatcctcgcccttcatctcctgaatggcagctcgagaagcctcggccactcgctcagaaaagagcatgacagcctcggactccagaggatacgagtccagcttcttgcctagagcgccctcgattcgcagataaagctcgagatcgtactgcgaaaccagagccacagatttgccggcccgaccagctcgggcagttcgtccaactcgatggatatacgacttggagtcgctggggatgtcgtagttgatgaccaggtccacggcggggatatcaagacctcgagaggcaacgtcggtggcgatcagaatgtttcgagatccacttttgaacttgttgagagctccaagtcgcgcggtctgactcagatctccatgcagaggaatagcgccgtatccaaggtttcgcagcagcagagaaattcgctgggtgtcggacttggttcgggcaaagataatcatcgagttgcccgcgttctcggacacgaggtagaccagatgtgtgtccttgtgcttgaagggacagaagaccatgtactgcaacaggttgtctgcagtctggtactttgtggaaacggccactcggacagggtccaccagagaggctcgctgcagcttctcgaccttggaggtcatggtggcagagaagagatatgtgtttcgttgtcgggggatgaccttgagaatcttgtccagagaaggtccaaactccatatccaacagtcggtcggcttcgtccatgaccaggaacttgagggttcgcagcgaaaatccctttgtgttctccagatggtccaccagacgtccaggggttgcgacaatcacatgaggcttcttggacagcgccaccgcctgtgtcatcatgttcatacctcccacaaccacagcggttcgcagacccatggcagagcccaacgcctcaaacgtctcgctgatctggtacgccagctctcgagtgggggctagcaccacacagtacagcggctgggggttctcgtacagactctgcagaacggggatggcaaaggcggccgtcttaccggaaccagtctgggccaaaccgatgatgtctcgtccctcgagggcgtacgggatactctgggcctgaatgggtgtgggtttggtgaatttgagctcctcgcaggtctcacagatggagtcaatcacgcccagatccttgaaggtcttggtttgctcctcactctcatccacctccaccgaggtgtagttcttggagctcttcttgggctcttcttcctcgttgtcggacttggtggtgtcgaggatttcctgcgcgatggcatcgttgtcctcggactcggacccgctctcctccttctttgctcgcttcactcgtttttccgtcgccttggccattgttgtgtgtacagtagttgtatgtgaaataatcaaggttcgatggagaaaaaaatgtgcatgcagcttcaaaaatatattagagtttatgacatgtgcaaggctatataaggagaatcgttatagcgtctccagacaacaggatcgggataatagaggagttgcaagagttattgatggaaaactggtccaatgccgctcgttgatttccaacattgttactcctaccgccgccacctcgttcttttgtgtttttcgcgatcgtcggttcgattcctggttgagtgaattacgcatatatttagctaactcggccagtttttaatagaaacgaatttaaagagggaaattgcataaatggaaaagcggatgatctgtatatggtaaaatttcaacgactatccttacatttttgctcacaatgactgtatcactggcaccgctgcccactatagctagtttgatctctacgacatgatatgacgataaaacggcttgatatgacggcaaaaaatcaatattatctactccaaaccatttcaaccaatgaaacctgagaaaatcccctatatcacatcaaaatcgccgctctacgctcacatctacgctcacatctacgctctggtcggcttgtctccatctcatcccaagatgcacgagtgaagcctatttcaaaaaattccaatcttgatgcaaaaaaaagcgggcaacttatcatcacacacgcacacaccaagactaagaaaaaaatggcagcgcggaaaagcaagaagagaacgcacgtccagatctccgaggaggacatggacaagatccccaagtccatgatcttcaagatgggctccaaaaaggtcggcagtgtcgcagcgtccccggcctctcagcatgcgctcacacaactagttcgagacactcgatgtgccatggaaccccacaccgccggcaaactgcgggagcgaaagggaaacaagctgcgggactttgtgaccatggctggtcctctcggagtgtcacatttgatgattttcaccaagggagagtctggcatgacttcgctgcgaatggctcgtgtgcctcggggccccactctgcacttcaaggtgtcgcagtactcgctcatcaaggacgttcggaagtttgtgcggtcgcccaagtccaacgacggcaagctgtacaagcagcctcctctgctggtgatgaacaacttttctctcaagagtgacgatgccaccaacccccacgagactctggtaacccagatgttccagaacatgttcccccctctgtctgcgcagaacaccagaattccctcgattcgtcgggtcgtcatgctcaacaaggacaaggagacgggctctatcgagttccgacactacgccatcgacacccgtccggttgacgtgacccggggcgtcaaaaagctcaccaaactcaaacacaagctgcgaaagaagatccccaacctcagcaaaaagcaggatatggccgactatcttctggaccccgatgccggagccttcacctccgattcggacatgtccgaggtcgaggaggatgccattgtcgacctcaacccggacgacgacgacgaaatgcctcttgaggagggccctagcaaacgggccgtcaagctcgtggagattggtccccgaatgaccctcgatctcatcaagattgaggacggcgtgtgttctggaaaggtgctgcatcatactcggattaagaagtcggaggccgagatcaagaagctggagaagcgacattcgtctgccgccaagatcaaggccgaccgaaaggccgagcagttggccaacgtcaaggccaagacagagaagaagggacgaatggcaagaggaaaggaaaaggccaagctcaagggagatgacggtgatgaggagaatgaagctggagatgatgaggacgaggagaatgaagctgaccaggaggatgatgacgaagatgacgagtaacgtcgtatatagattaattcatgattgtataggttctgggagagtgtagtagtcgatatgcgcttacgtcaatccacatgtacatactcgtactgtatgtatactccatcgcttgtctatactacgagtgtaccgctcatctacaatagctattaatgtggtcatcctgatcacctcaaatcaacataaatcataaatcatcatatatatcgtttacatcgttcatatcgttactaccacaagcttagtcgttgtagtttccaccagcagaaccgtccttgtttcgaacaagcccaacctcggcatcaaagtgatcctgctgggaagtaccgttcttgtcaaacacgggaacctctccagtcaccgttactcgcactccatgtcgtcggtaaggatagtatccaaacgaggcgctgtgcgaagtggttcggttgtcccaaaaggccacatcctgtgagttccacttgaatcggacagtgtcctcctgctgggtagccaccagagagttgatgtaggtcatgatggcctgggactcggaggtggggatgccccgcagagcagtcacaaagccggggttaaggaagacggacttccagccggtcacgggatgtgttcgaatgacaggatgttcggtctcaatggggtctcgtcggagaggctggcccacacgggctgagtctgcggcctgggcgactcccgagtggatggcagtgagactctcgaggtacttttgcatgggctcagacagcgagtcgtagacggcgtagttggaggtccacaaggtgtctcctccggttggggggttggccagcaccttgagcgaggtgtatgaagggggctgtttttcgtaggtgacgtccgcgtgccacaggtgggtggctgggaaggctgtgttgggtttcttgtggtagtcggtgtagaccacgtggacctcgtcgaggtttcgggcctcccagtctcggggcacagaggtggaggcgtgcttgtgcagggtgccccagaaccggccgaggttgagctggtcttcgatctcaaagtcgggctggtctcggaagaagacgcagcctcggaaggagatcagacgggcgagttccttcttctgctctgtggacagcgtctttagagaaacaccgtggatctcggttccgaaccggggggtcagctcaatcaccttggacgcgtccttgaacaggtttgtgtagttggggtccgcgtcgataccggcgtctgtgtaggggacttcctcgagggggtcccacttgaggtccgggtagacggggagaaggtagtcgtacttgtagggtgcttcgacctcggcaatgaccgacttcagggtcgagacctggggggctgatgatgccggcgagggcagtttttcagcgctgggtgccattttagttgttggggtggacctgattgggttgatgtttgtatcgggcgtttgagtcacgtctgggttcgtcggtgctcgaaagtggctctgaggagacgcgtgagaagtcagttgaggagcgcgagaagtctgtggagctcgagaagtctgttagggagctcgagaagtctgttagggagctcgagatgtcggttgaggcgcaaagtcggtggaggcgcaaagtcggtggaggcgcaaagtcggtgaggtggcgcgagaagtcgattcaggctgtctcgattgaggctggaaggctcgtctcgtctcctatatatatcctctcgctgccggctgtcatgacgcaatagccatcagagtttggcgcactgattgtgtttgattgcgcaggataaagtgccagccacagctttggatggcgccatgcaagcgctccgtggtgcgacatggcaactgtggcgtcgggtttatcttgtgccgcctttgggggctctttcaaacgcctcgttgccacccacggtgtggaaagtgcacggccctctttttcacactcggcgtttagccaatcggctggctcgacacttctccgaagcttaaatcccgaacgggctattgccgaaacgtctacaataatggagatggatggaggcggatacaataaggggactagaaaagccgatggcgggaacgggattttgcacagggccagcaaatctggatttggcgggggtctcggtttaaccatcgcgtgaccctttcgagagaacgagctctcggacttgacacggacagggtttgtgggggcacgttggagcttgacgtgcatgttttgaggaagattcatgagatgagtcgagtctggtggaatgtgcaagattggagtgttcgcatcttgtgtgaggaaatcacatcttcttcgtttctacagttactgtctacactttctatctacactttctgtctacagttactgtcctcttccgtccatttccctctcccattgcctctccttttgcctctcccttttttattctctccttcctttcgccctcagccttccccagacaataccgtctgtttttcgtagcggggaaatgcatctcaccatgcaccggaccaaacatgattttgaattcggacgagatcaaaatgccgaaacgtccacgccagaacggaaggatatcagcgttgtgcgcgaaaccgtggcttgaacgggtcgcggtgtgtggcggtgttcggtgttcggtgttcgcatttgtttcggtagtcgagaccttcgaggtcttagagcctctggtggatggtctctggtgggttggtatctggatggcatctccggtttatgttttacagattagaatatactgtaaatgtgaggaggtatgtactttcaacagaaaatataaaatataaaatataaaatataaattgcatgaagtattagctacaagtacgataccataaatctatgtactgtcgatacaagtgcaagtcaagtacaagtacagtcagtacagtcagtgcagtcagtacagtcagtacagtcagtacaagtacaagttatatataatggattactatacattataaatatatataacatacaattattacaattaatacataaaaccaaataacgtacacctcggcttatgcacaatggagtcgtgcgactgaaataatatcccgcctcctcgaactatttttagtcctaaaataaaatgcttataccttagcattcattagtacactcgtacaacgtctttgagtgacgataaaacactttgtgggcagaaaaactgtctaatcaacagtataaccaacagctctacctatttctacatccaccaccacctcccccatctcctccatcccctccactctcatccctatagaatcagacttcggcgtgattacaaacgtccggataaacggcctgcagcacggttgtacggcgtttcctcggggcaaacgtaaagataattacgtcatgacgtgctggaacgtgacccgagcctccctcggtcctcggtcacatgaccgacccatgtcgaggcgtttggtgggatgtgtgcaagtgacttgcatgtgactcgttggtgactcacgtggactcagatgactcagtgactcaagtgcgcgtattaacgcgaaatcacagtcatcttttgtcgaataaattacgtaatatttcatccaccaatctgtcgagagtcaaacctccgataggagcactgtatcgcgggttgggttggttggacaaagtaattatccgatggactcggagatggtgaaaatccaattccagtgattttactttagaggtacagagtaatatgtacagtaaaatcgaaatgaaaaaaaaaaatgaaaaaaaaaaaaaagtaaaaaaaaaaagtaaaaacatcatccgtcttcggaaaaaacggttctggggctccaatattacccaatgtcataataatagtaagaaattcaactgtactataatgcatcattagaaaaatgctttttagtatttttgatactgatattttgcaccgatatcgtcaaatttcgtggggaaatgagtgcagttggccaaaacacgaatcagtatctgaaattagaagtgccaaacgaatcaacagtcgtatggaaatgaatattattggttttggacgggagaggagtacagctgttgttttttttggttgattggttataatctcaacaattgtactcaatctacagtaacagctcagtcgcgcaggactaaacacgcctgtcatgatattcatttaaactccggacgtgacgcgtcacgcgtgataaataaatcgtcagtaagtagtccagcctatactcataaaacaccacaatgaaggacgcggaaactacaacggtccgcgaactcggcccagatcacgtggccaatgacatttattcgtttctgaaccgcaaaccgtgcgcgcgacaccagagatcagatgcgaccaaacacacatgcggatggccacgagccaggctaccttctcctccggctgaagaagaggggcccgagaaactggagttgctggcggatgcttccaggagattctccctggagtcggtgaagacaattgtgggtcctggagtgctgcagtatctccaacgcggtggattttcgtcaggcgatttggtgaagaccctgcagttgtttttcagccactcttccctgacagaggagcagttggcgatgcgattgcagcgggccaacctccgtagtctgaatgcctttatggagactcttgagaccggggtttatcctgccaagtgcttcctgctgggtcccaggtacatcccttcagagacagagcagtccacggcagtcgcagacaccagagaaacgactaccggaaaaacgactgaggagcgtaccagactggacggtggaaactctgcaagtacaattgtccctcctcaatcgactgagaccgagcttgcaaacgaaagagacaatggtcaaacaaaatctgtgccggtagtaattggcgagactgttaagactggcagtactagggccaatcccacaaaaccgtcttctgccaacgttgccatcccacctcacaatgccccacaactgactacctacaaacggtcatttcctccgttatctcccctggctaaacgacagtgcatggacgtcccttcttaaccccagggggcttggtccttaagctacgagctgtgggatattgaacagcatggcaggtttctattgcacaacttcagccattatccaggagtcgagagagagcggtttgaactggaacggtgcgtgcatttcatcggttattttcacaattcccaaggcatggcactggatgttggcattgccgagcagatctcgattctgcgtgcgcgtggcgtgtcagttgtagatgggtttcgggccgctattcagagagtgcaagacaatgggactctattcgaaagtgaagtcgtgggcttgggatgtactactcaatcaagtcatgcctttgggatcaaccatcaactccctcagtacacatctattcataagcctcctcagctgcctcaagtcccgctgttgactccgccccgttacaccaaccatcctcaaacatctcccaaagtggcctaccctcatggtacccgtcctccaatcttgactccacctcaccaggcgcattcctcgcctccgataacgcagcgcaaggaacaaaaacaggtggtgcaagatgaaaagctggccaagatgcaggataagtctccgattgtcaagatttcaaataaacccccagctgttcgctcgacttccaataactcggctgccaaaacacccccttccgaaaccacctctaccaaaacgactttcaacccatgcgcgcctgtgttcaaacctgctgttgagtcaacacccagatacgtatccaagcctcccgttgcatctaagcgagaagtctcggcggctgctttaatggccgtcgagttgactgatgacgtcagcactacaagacgcccatttccacagctcccagagagtgtggttgaaaacatgtgcttccacctcgatctggaaacctgcattgctttggctgatacaagcactctattcaaaagtgctatccgtaaggctgagaatacgctgattcgtgacaaggtccagactcgtattccttgggctacttctcttgaagcacatgagtcggagtacacgtcgtggttcgactatggacgagtcgtggtgtcccgagcaaggagattcagctcgaatgccgcgtcctgggcatgtgctgacaacctggactcgattccgcggtccgatctcacgttcattgaccctgtggatgcccaaggtcgagtggactttcagcctttatttgagggtgcctttttgatgcccttcattctccagcgtgacgggctcagtgtgtttcacttgcagggcaactgtatctttaccgactacgtatcgttgaacctcaagactttcaaggtccagcaggcggccatcaagaccgagccacttcacactccgaagaagcacgctcttttcacgcctcgaggaacaaagatgttcgtcaacaacgaccacgcctccattcagtttgtggatgaaaacgaccgcgtgctgtggatcaaggacggcgagactaatgtgtttgtggataagtcctgtgccttcaaaactgaagacggtatcctcaaatacgaccgcgaacatttttccagcatggtttcgtcttttgagccgggctttggcaagcttctgggtggtggcgctggatttattgggcttctgcgctctggttcacagtatcaagtgtgttactttgacgcggtggcagaccgccgacagaaatactgtttgacttctttctcggcagatgaacgcgtgctcaaaacaatggaggttgtcgtgttcaatggaatgctgcacatcaacctgttcaacaccatggttcctttctgagtggatttgaagttgcagcgacccggcaagaagctcaacaacatctgggtgactcccgttccggctggggtttccaagtccatgaaggcgttccggttggcagacaactccgaaacgactctcgagaagaccaagaatctaaaacagtccacattccgctcggtgtgtggtcggtttgtctctgcttcggtgagtcgaggacgggttgttggagacctggtcactggcacttcgtactgcgtaaaagaccgtagtcaaggccgtcccaactttgtgttccccttcttcaacggcaagacgccctctttcatcagatggaagcgagctacagccatctccatcttgaacaagctcagcggtgatcttgctcgcagaggtaacaggactggttttttcatggatcggattccatacgatgtcacggtgaagaaaatgtacaagttttatcatttcgatcctgttggacccgagctcgttattcaggtacaagggagattctaaggcggttctaaggcgtttctaaggcggttctaaggcggcggttctaaggcgattctaagaaggacggtggaacgtcatgagagggtcttattggagggtctttgacctcgagacttgaacaatacatacagtagttactcgtacaagcacagtatatacaagtccaagtatatcaagtaatagtacattaaatacaatacaaatactgacaaatacaatcacagtacatactgtattgtacagcacaaaaacaaacacgtttccactcgtagtcgtacattcttctagcggaacaaatcttccgaaaatgcacacaccccagaatcgaacagtgtacctcggccaacttctggtgatgaccctgctaaacattgattcattgtacccaccaatactgtatcaatactgtagcaatactgtagtaataccagtaagagtagtcgtccaacttgtatactgttttaaactcgtttgtcgtcctctcgaatcctcgctacacaagcccgcttacgtcctcttctttacgtagctgctgactaatctcttcactcgcatgcacggaaaagcgaaactcccaaccttcttctccatcacgacacatagctatgggcctgatagccacgattctggcggtcttctggctgctacatcgcgccacacggttgctgaagatccccgcgacgacgctgatccggctgctgggtgtggatatccccgagcggcccgacatttgtgtggatcatgtgtccgactcctcggtcacgctgcgatggcccaaaccggaaaagaccacagctcacaaacatatcatcgaggtgaacggcatcaaggccggcgagagctcgaggtccacgtcggttgtgctcaccaacctgcagccggacaagacgtactctgtcaacgtgctcacggtcaacgcgaatcagtacagatccaatacaaccacagtccgtgtccacacgcgcaaacgggtgcagcacccgtctctggactctctggcgcccgttcttatggaccccgtgaccccctcgtttgtggtgctcgcgtccggaacaggaacatcaaccgcatctacaacctctggcctcagctcggccaccagcatccccgccacctctacggccgcggggctcaagcacaagaaacacaaacactcgtcttccaaaaagctgagtgctgacaagtctgcatacacggtggagtcactgacggccgaggtggaggctgcgcagcaggagatccgggatgccaacatgcagtatcgagaggtggagaaggagctggtggcgatggaaaacaagctgcaggaggagtcacaggagcttcgggcacagcgcaagaaggatgatgtgtcccgatcgcagctgcgatccgaaatgaaggccctggaagaccagaagctcaacattgagctgcacagggccaaggtggacaagcagctgcagaaccttgagcagacgctcaaacgcatggaggtggaagagagcaagtggatcaacacgtcgcagatcatggagcgcaaaacggaggatctcacaaccaccgacacagaaacgtaccacgagaacgccaacaagaagctcgtggaggccgagactctacaaaagtcgctggcggccgtggaagaggaggtcaagactatgacggccgagatccggcagcttgacgccctgcgaaagagtctggcagaacacggcagcagtagccgaggcagcgatgccaacaactcgccggaagctttacttaagattctcgagggcacatctgacggaaaggccgagatcttacgccaacagatccatttcgataccgatctggaccaaaagtggcgagacgtgcagcgtcagcttgagcagcgatatgtgcaagtgtatggtgagtacggcgaggccacgcggctactggagtcggcaaagatccagtaccagcagttccaggtagtcgcaagcgccaacaacagctcttctcaaatcatcgataattccacgtcgagcttcgatttcggatcaagtcgcgacatgatcaaacctgagcttccgccttccaccagtgctccggcccagtccgttcctgacgctggacgccgcccctccgcatttgaaggagatgaaaacttcaatactgcggtgcaaatgtttctcccatccaatttgtttggtgctgacgatctcaacgattccctcactcagtcttcctttgaggcaatcgacgaactgcccatgaagggccctacataccctagtcatgcccagaccagctctccgtccagctcgtttgacgctttccgggtgtcttccgaagaccccaacagcccctccttcttctccaaggactacgacatggacaccagctcgcccgtgactcgtcccaaacggctctccggcatgtttggattcaaccgagctaaggccacgcctccccctgaacctgccaacaaaggctccctcttcttccgtaacaagcgcaagcaggagggcaaggagcccgacgacgacatgctggtggctcccgagtcatatgaccccttccaggcgtcttggaaccggtccaactctcccggaggcaatatctttggacccagctttggcacctccgagtggtctggatctccctctggagagcaagattggagcaaccggtctgtggactcttatggaggctcctcgggtccgtttgctcctggctttaaggcgtttgatcagcccagggagctgtatgacgacaccgctgaaccacatggtgcttccagcacccacagtgagtacagtgccatgaccgatggctccaaagactccaatggacgagaaagcatcattcaaaagggaatccgaaccctcacctctcccagaaaggggagcacgtcttctgccaagttcaatgttggtaagctgagtttttttggcggcaagaaaagcgatcggtcggatgcttcttccactgacgccgagctggacgacgttcccgatcagggtgctctgggtgccattcacgagtcccggtccggcactggaagtcctcatcttaacatggaggagtttctgaagcagacatagatactaattattaatacatcgcatgattgaccaactgcaagtacatactgtatgtactcacttgtagagattctcgttgcgacaaaattgtggacaagacacgaaacgaccatgtctgtaaagtcacgtgaccaaaatcatcacagcagaaagtcgagttcttagatatcttccacaagagttgcatgttttatattggacagagaaaaagggatgtgtatatgaaaaactttaatttcgggcagattccaaaaaataatgacatccgagagattcgaactctcgcctccggagagaccaggatattgattcagtcacctgaacctggcgccttagaccactcggccagaatgccaattgttgaaaattatctgaaatttatccttgtcaaggttacaactgcctaatcatcgtccccagactccaagtccgatttgcaggaatgacattgtttataggtctaagtaactgaaaatgtattcctctagaacgaatagaatatcccccgattaatcttggattttttagacgtttttaacatacatacattcatcaacattattcagtaaatattcagtatttttagcctaagacgattacaaccgtctcaccaaatgtgtgatacatacgtctatcaaatgtgtatgattttactggaaacgtcgcaaaactgtcgtgtggttgtccttgaccgattcaactaatagtgctctacatagaccaaatttttgagaggaagaccaaggaggtttcgtatactaaggaaaaccaaggtggtttcgtatactaaggaaaaccaaggtggtttcgtatactaaaaaatcaaggcggtttcgtatacaaaagaagaccaagaagtcttcgtatcagtaaaaaaaaccaaccagagttttagtatacttgcggcctacgattgatataatcggactagtcttccaccccggtcataactgtgcggctcgaaaatgcaatatagccgagagtgcggctcggaaatgtcgatccaggtgttcggaaggtgttcatatctgcgaatattgctagcgaatgtggaataaaaacgacagaatcagttagcaaatgattaatatatcgatttattgttttatctgcccaggtggcagtacaatatcttccactaatggtacatgttctgatcccgggctgttaaacgggttccaaattataattaagcgagccgcacttgacatccgtctaatcaccgtgtctggacatgattcgtgcaagtcgcacagatcgtcagtctcaaggcaccacgatgtttggggtataaaaggaggccgggggacgtctcaattccccatccacataccacctccaccactaccaccaccactacaaccaatatgaaggtccttcttattctctacgatgccggctcccacgccaaggacgagcccaagctgcttggatgcaccgagaacgagcttggtattcgagactggctcgagtcgcagggccacactctcgtcaccacctcttccaaggacggtgccgactctgtgcttgacaaggagattgttgacgctgatgtagtcatcaccaccccgttccaccccggctacatcaacaaggagcgaattgacaaggccaagaagctcaagatctgcatcaccgccggtgtcggctccgaccacgtggacctcgatgctgccaacgcccgaaacattgccgttctcgaggtcaccggctcgaacgtccagtccgtcgctgagcatgttgtcatgaccatgctggtgctggtccgaaactttgtccctgcccacgagcagattatttctggcggctgggacgttgctgcggttgccaaggactcttacgatctcgagggcaaggtcatcggtaccgttggaggcggtcgaatcggccagcgagtgctcaagcgatgcaagccctttgaccccatggagatgctctactacgactaccaggctatgccagctgatgtggagaatgagattggatgccgacgagtcgagtctctggaggagatgctctctctctgtgacgttgtaaccatcaactgtcctctccatgcctccaccaagggtctcttcaacaaggagctcatttcccacatgaaggacggcgcttggctcgtcaacactgctcgaggagccatctgcgtcaccgaggacattgtcgacgctctcgagtccggcaagatccgaggctacggtggtgacgtctggttcccccagcctgcccccaaggaccacccctggagaaccatgcgaaacaagtacggcggtggaaacgccatgactccccatatctccggtacttccatcgacgcccagggccgatacgctgagggtaccaagaagattcttgaggtctttttctctggcaagcaggattaccgcccccaggacattatctgcatcaacggtcactacggtaccaaggcttacggtgacgacaaggagcacaaggcccacgtttccaagtagctgtttaacttatataagcaattgactggatttgataacgaaatactcccttgtggaagctcgtatcatcgctcgtagtacaacgtagttcaatatgccatagggtgcgtcgttcggatgtcggatgcctataagttgtcgtcgaagaagtgattgtgccaagggtctccctcacgtacaagatcccccttatgagatcccaatgggcgtttcgcactttgtggactataatgtcaagacgtctgcaagctttcaggtataggggatactgttcagttgataccgaatcgtctgttaacccaagaatatcttgatcttcatttcatctaaagtagattttgtttccagttaagtgttcggaaagtggtccattgtggacgggttggcaaatggactcccttgaacccttgacttctgcaaacaaccggaaacttggagttgtatagtctctccgacatgtagagtgtcatcatcctttctattcccatccgcagctcgttgttcctcctatcattgttcattctgagagaggttagaactagtcaagactctgggacactctgctgcgggattttccaccaagagacgaagtacgagaacccttgagttcattgatttaaatgttttataagttttataatccaacatcaacctggagtttacgcgaaacgatttccgctagaacggtagaatggaaactagtacaggtggttcaatgtggtacaagtacagcacagtatagcagtacaagaactcgaccagaatgtattttactctcactctactgctcaaagtatactgtctattgtagttgtagttatttcaacaccatcaaccaacctacacaaccgctgtcaacgacatctctttgaggtggtcgacaacagtctccgacagcacccctgctcctggcatgccagtactacatatcgaggagcgacaggagggaaacgtttttcattgaactatccatccaaacggcgctgtaatagctctcgagcagacacattgggaggtgcgtgatcctcttcaactcattctccatcaacatccatcatatccgaatcggagccgttttcactctcgtgtccttcatcaaacgcattgccttcttgtaattgtcaatcagataattggaaaacgttttgttcaggttccccaacgtcgctcgtcgtgcctgggaaaaggtctgcttctgacttggcaggagtctcaagttgtctaggtctctagccatgcacatgtccatttcggcgcgagttagtcgtgagtcggacaagtaacaattgggccatgttactgccgaattcttgtgagctcgcccttctcgacccataatgaggtccagtctcttgcgggcctctgagatacatgtggtactgagttctggtgatcatgtctgccgggagccactgggtgcgtaatctcagaggtcagagggcatctttgacgagtgtaagaaaagttacggtcttgccagacacagagagacgagaacttcaatactggagacctcaagcctagacaaacaaagaggagtttgcgtttttcggctttcacctgtgcaggttgttcttcttgtttgggccgaattggagagttctcaggagactttgttggaggtggagttgttggattatcagaagggttgcggtaggatttgagaaatggcagcccttctagtgaaagtcctcgtctctctatcgtctctagctctgcgtcgtcttcttccgtcatagtcgtctctcacttgatttcttctttgatagtcgtctctcacttgatttcttctcactgatggtcgtttttcacagtatcttctgttaggggttcttctaaaggcagaatgtctctcctgctcatagtttggcaaaaatagagagtctagagcatctctatcgtcttcgggctccccatctgattcttcagaatcacattcaggaccaaggctggtctcatctctgaagtaagcagccgtcccgtgtgagagcgtccacgacgctgacgcctctcgttggcctcgaagaacttcgacaagaagatcttcaaagaccaaacgaatattttccctcgtcgtcgatatccttcagattacgaaacccacggaacggccaaaaaaccaaacttcgccccaccagcgtacctctctccgcgtttgcccaccaacgtgtctctctacccacgctaaaccatcatcagactctgagacattggtaattatcgcgtcaatgcttcagaccgcgtggatctaccaaaaaaacactttcactttggcccaaatcgcggttcacaagtacagcttgtacattcatacgatcacgctcgtaattcatggatatcgcttcgatattggtctcaaaatgaccactggactgtaaaggtccaatttttcaacttgcggaaaacaatttatttgcacttgtcccaaaaagatgcacttttctgcaattgccagcttcaaagaagctctctcggtaggggagtgtagatagacgctaaagcgagacacgcttcgatcccggtagaagaattcagtttcatcaaaagatactttgcttttttgattctgggaaatacgttccagcttctgtatgagtgccagtgcttgtaccttgtccgatagccagggatcaacaacttcagttggctatcactggcgataatggtgtgagctgtttcccaagaacacgtccgtgagatcaagcttacatatgcgacgtagagctactgtagacagagccagacagcccagagccagacagcccagtgtagtgggagtccacgagattctgggtgcagaaagtggacgttggacgttatttattgagagtaccttacaagtatgagtggttatagtacgacaacaagtattttaccgtgtccgtactgataaattcgtattagtacgtaccaccagctacaagagtgtgctatattaatcaatcaactgctcatgtccctgaaatccctccaatctggtagatccacagtcgaactacagacatgttgaaccaatcacaactacttgcacaacaaactgcacaacaaactgtacaacaaactgtacaagaaactgtacacacccggtcgtcactgccattcacacctacaatttcgtctcctgcataaactatactttctgatagtgaaagataaggaactctaatattttggacttaccaagtttggcaacctgaaacatagacctggctgcggtcatatctggactttctggctgtgactgacacaatggtgttgagtagtgctaattgtgacgaacttgtggtttgtagggttgaatttatcaacaggtaggtgtacagtatatacagtgtgtacaggactcgtactatgctcgtatgaacattgttatgaacagattcgaaacagtaatctgaaatcgggcaactcttagatgcagactctgcgagttcatgccgtgtagttgcctggtgtacaactccctgcacggatgactatgccggagtgctttagttgcctgaaaagcaatgtctccatatactgttgattggaatcagcttcttgtacaatgttctaacgttgtagaaaatggaaaagacatttgagaaatcaaacgaaatcttcagaagaagcagcacttgctatgcgacagggtatccaaggacctccggtcactaaacgtcatgttaaacaaacgagagtctctcgccaaggctcgggtgtgtttgcttccgataaagacagctattggggattccgacaagggtgttgggaattctagcaagggtgttgggaattctagcaaggatgttacggattctaacaaggatgttgcggattctaacaaggatgttgcggattctaacaaggaatgttcacttcttggtgggaagggcttcagatacgatctctcgggaccgtagcacgggctacctcaagggggacagcaattgactccgtctgttggagaacgtcaccacatggttagaagtgtataaatacaatatattgttttctcttctcgaaggcaaatcgagaatagtacagcgtgtacatactgtacacgaggaagtagtccgacagcaaagagggagctctgggtaagacgcctgtatcgatttaattggagagtagcgtacgtgccagttgttcgccacatcttttgtgtatgcaaccaccaagacgaaacgagatgacattgagtgatttgaaaccagtacaacagctcataaacagaaaatccctcctcaaaacccgaaatccacagaatgatatcacaactcatgggaatatcatctgacactgctctccatacaattattccacattagctactgtattctactgtcccaatgaagacatctgaagcccgatccaatgcccactggggcaataagatccaaattttttacattaaatagctgataaatacctaaattatgccatgattcatccaaaagccggagatcggcaaaaatgaacgggttttcaacggaagtaaggccaaaaaggtctaaaacactaccccaaaaaaacttcaaaataataagttcgggctgttggtgtagtggtaacatatctgccttccattcgattgttagcaggtgccaggggttcaattcccctacagctcaaattttttgaaattcgttactacgttgtctacagtatatattgttcagatgaactaatgccagctgccagttcaccttctccactttttaatgaccgtggaagaggtccaatatatgcgtctatatgcgtctgtcgcactgcaccttctgtttatgggagctctctactctatggaccccgtggggagtaatatgggaaattatgggggaataatgtatatatatcggtccagttgccctgatccttgccagcttcaaccgccgccagactccatctctcttttcttttcttgtctacctttccttttaatttcttgttctctgtaatgtcaattttcggaactccctccatgttcggtcggcctatcgaccctttccagcacctcatgaacatgcggtgtgcccacgaggctgcccacaaccggttccggacccagatgtcctcgtctgaccccgaagtgcgacaaactggtctttccaaccaccacttgtacctcaagcagctgctggacgagcaggccggctacgaaacagacctgttcaagtgtctgaaacatatcgaccgggccgtggcccagtggaccgagctgtaccgcctgggcaagcgctcggaagctcagcgggtctgcaactcgattgccttcgagttcagagacacttgtatgactctgggatttcgagcgctgagccagaaggagaagaacgagctgcttctcgacatttgtctggcgtacgaggaagacatgggcgccaaccagctgcgaaactacaagttgtaggtataatttcacccacgaacgtatatatgaatgcattgctgaataaatgtagacatgatggtcactcggagagcccaacaacatcaacagataaaccaagaccctctgtgagaccatagatgggactctgacagcccaaatctccaatatctgccttgtacacggtttttttgttcaaatcaaccacaaaaccacgaacatgaggagtggaaaagaggaagagagcatgctgtccagaaacagtcacatgaccttgggtctgtttgtcaatgagattcgctggaagagggactcggtaacatgcggaggagatgggatcaatgatctgacccaccttgctgccagaccctccctcaggatactgagactcaattacaacgagagagtcagagtaagagcatataatgtggccagagatgacacacacatgacccaagtcggacatattgctggtcttgaccagcctcagaattcgttctcggtgccaatcgacccagtacagagaatcagaatcatgcaaaaatgtctgcttcttgtttctttgaagcagaatcaacggggaactttcaacggtgatagagacgccgtttctagacacagtaacggttccatcacgtgactcgagccgagcaatagttttctctgcccatgtttcagccatctcatcgtaaactgatccagcctcccaaacccgtaccatgtcgacaggaaccagctcgtcgtcctcagagagctcgtaatcggtccacccacgggatacaatgggcgtgaaagtgtcgagaaggtcacgtgacgagtcggactgtttctggagcgtgtcgagtgcaaagtcgcgtttttgaacgtcccggatgtctgagagcaacggcagaaggcccggagttccgtctgacgatccaaagaccaccgcctgttctgcggtcacgtggctgacgcttccaacggtggtctgattcaatttctgggtccaccagggtgttggaagggtcagcagaaaacttctccaagtggtgcagcttttggccagttgttgcagggtccacagatcgacatgggccagcgtttccgcggccatttctgcgggcagttgttgtagggcgtgtagtatcgtcattttgggtgtcagaatgtcttctccaacttgttgatggtgttttttttttgggcagcttggatttatcttgtatgcagttggtctgctctatcttgctgcagaactctgttgtgcaaaagtttatcagcagggttatcggatttggcctggatcgaaaacggcgcttttctctagggaaagctgaagaagggcgatattgacagtaataggtgtgttatttgtgccacgtgtgtttattattcatcatctcttgctccacgcgctttccagctcgttttcggatcccgtcacaacttgcttctattgtggtgcatttaagcatgaactgaaaatctcggtaaactggataaaagaaaaaagacaaaaaaagacaaaaaaaggcaaaataataaaaaaaagatacggaaaagctgatttcgggtcaaatattggtgagggaaacggcgggaaacgttcggaaaaaacccacagatacagtccaaatacagtcccaagtagctcgccgatctttcacaccagcggcggactcttagcgcttttgcagctcggtctttggcggagcgcagatctttccagggttgaggcaaaggggcgtaaaagaggcgagtgggtccgtggctagtgtctgcggaaatagtggacattaagtggcggggctagtgccggagagctgtataatgcgactcaatcaaaagcggggtcggtaaaaccggttttagtcgttattctagccgataaccaccttttattgggtctttaatggtcgttgccaaatgttgatactccctcgacaaatgttgttcacgtttcggaaccctatacaagtacgatataactccggagagccgggggaaaggaactttgattgcacgtttgggggcgcaactctgagttatacggtccttttctgcgcctcttgtgttgcctttagttccgtttagccacgtttagccccgaggctccatctagcccatctccatgtagcccctcatcatgtctcacttctcctcaagtgtctgacgtgagtacatacgagaaggcgacatgcttgtagaccaggttgtacgtagagagcccagccaattgtaaaagcagacaagtcactgagaaaaagattacagcacccaggattctcgtatggtctcccactacaatactaactgggctctctggtgcttgactatggctgatcggacgggaagccgtattttcaccaggatatggccgtaaccaaacctccgatacggggaatcgaaccccggtctccacggttctcaacatgagagcgtgatgtgatagcccctacactatatcggattttttatattttaccgagttatttctagcgtattcaaaatctgacgtttgaacgctgaataaaaaaatatgaattatgaatcattagaataaaaaaaattattagaataaaaaaaacactaatgaatcattagaataaaataaagaaataaagaaataaataaataataataataatgaaaaaccaacaaaaccggaaatgaaggataccatcttccattatagtgtatctagattgatattttatcccctttttttcgtttactctcaaattgtgcaactagcgaggtccgtaacctccacttattattgactattatacgtaaataaaaaaatagatataaataaatataaatagatataaataaatataaataaatataaaaaggataaataggtctgtcagatctgccaagcggtcagaaatttattcacaagcccaaatccccctttgaatcgacttttatccaaatcagaccatttttgagcccgtaataatacctcagtccggggaatataagcttcaagtagccgaaaaaatatcagtgttgagagatcatcaccagcatgaaacggcaggatatcttcacttgcgccgccgcctgagtcgctgctcagtccgtgggtgtcgccatgctctgctcgccgccgccccttacgtaatcgcgataaggttcaatttaggtgataatcgcgcgtctgtcatttgtgcacgcgttttatcgtcacgttcaaccatggaaatcgtgcagcctctgaaagaccagatcgaggcattgcaagatgacattagtcagctggaaactaaaatcgaccggctgacgacgcgcaaaccaaactaccacgtcacgttactcaaggactggcgccacggagtcgatcccttgaacccagccattgtctacgagtacatgtctctttttcctccgggagttacgctatcgtacggcggagtgtgtgatgagacagacggacggctgtttctcgaagatctcgagtcgtttgttcctcgaacggggtgcacgactgccgacaaccattctcgagcagttcttctggcccacgccattaagggcccggtgctcaacgcttggtcacaggcctacaaaagccgctggttcggcatgcttgagtggatacctatgcgcgaatggtttctcgccaagtaccagaccaccatggatccgatggactatcgacaggttgtggtagggaggctgatgcatctacaaaagggcaactccaccacggatcagctaagagtggtggaatcggtgttgggggaaacgtgtcggctgcacggaaagctaagcaagcatgaaaaggtggttttgggacgcctggtgggtgtcaagggcacagacatgacctgggagactgtcaacgaagagctgaggacgtttctgaagacattccaggaacggcagttgctggacagcagggtcaaaaaggaggacaggatgtagataatcaataaacagatcaaatgagctggtggtggtagaactggtggaatttcaccagtgtcaaacggcgtcaacactacgacaaaattatttcattggacgcgagagtgtcacgttatctctacgacgattcaagtgaacccgaaatgggtcgactctcagcttcctggaacaaaacggttgacgaggtatgattgggatctccagaatgaatccaatgacatattcccatatcactgcgtgatcccaatgactgtcgatatgttggttgtgattgattggtacatcgcctgaatacagtaccattggtaaacgtctttggttgtctggaacatggaagtagggtcacgtttctactctctgagatgaaactgcatcagaaaatactgcggactgatgtcggcatctataatccgaccttgccaccagaccctctttcaagatattccgagtctgagtcttcagttggtggcctctgagtggtatggcgctaatctaagacaaatgcttgatcttgaaggttctggtcaaggaggagcagacccgaccctgacacctcttttgtacctgagttcgggggttgtctggggacactgcaggattggcggttgataatggacttactcagaacgtatgggttatccaggtcaccaaaatcttcctccaccactgatatagttttttctccctcgtcagcgttgcgtcacgacgacaatgctctgaactacccctcccggccagttttcatttcatctcatgtcactgaagactctgggattcgacacccggtgtccgacctctgggatccgacctctgggatccgacaccatatgccttgttttgagtgaggagttggtttcaagatctttcgatgtcttggagtatgggagtaaggtgctggacccgtcaaaactacaagcccagacaagtgcgaggatctgcagtacaagtagttgccccctcattctagattaacgagtttcaccttgagtccacagataaggaagagatgcaacaaaaccaataagaacactctctggatcgtctgctattgagattatggcaactgtacctttcggtcctagacaaacgcaaggatatttttggcaaactcgtcgtcgtcgtcgtcgtcgtcgtcaatatcagagttagttggacgttgtcagttgcgtggatcgtatcctttttgtcgtggaacaatggataatttcgtggagtgattctgttccagacttgtttaccctcaaggcaactccttttagacccgttgtgtggtcaggagtgatgttttagtcctgttggagtgtccaaatttcgatccgtggaacaaagaaaaaataaatacggcgaacaaaggaaaccatgcatatctgcagagatccgcataatcagacgtaaaagaggcaagacagatgaggtgtcgaataatgagcaattgggggaaacaaggtgagataaacggaagtggcagatttccccatttctcgcctttcaaagagatcaatctgtggaaatcctggttgctggctgcaaattgagactagtttcatcgtggatacagttcggatggaaagtccttgtttcagaagcagcaaaacactgaaaaacactctgacttcatcggaaaactgtagataactacttattaaagtcgtttttttcttttgtgacaacttcgaaaacccctcttatcgccctgtaccaaaatgaatgaccaagttgcctcactgtcaccagtcgtgtttgcctgaaccctcgggcctctccctctttcgctgcaacggcaattccaaattttccattgtttccaaagatgcaaaagtccactaagtccattctctagttctagctggcgtctggcccttcttcaagacgatgctggaagccaacatgaacgaagtgtctgaaaagaaaagaagttggagatgccctatccacatgtttggatcgaggctatgcttgccttttttttttaacgaagaagaccttgacatggattttcagcaaaccacagagtgctagtacttgcccagatctacgacattcccaaactgcgcgacctagcagttaggaagttggtcaaggagaccttgaccgtcagaaagtgcgtggaaggatggaggaacgtctacgaggccagatgtgactcgatgcagcgctatcttgcaacattccttggtgagcatctgcaagagattcaggggtccgctgacatgttggctcagtactcccacgatgaagctgtccggcttatgatagacatataaggagaaatcctgttagtcaatggtgcaatatgtttatatgcactttagagaaccaaagtagttattgctcaagtccagatggttcctatatgacagtaggtacaagactaacacttttaaatctcacgttactcatcatatgattacatgaaaaagaaatcgactgataagagcagtatgcgagttccttgaatactctaccatctactattcctgtacatactgtatctgacactgtctcaccaagtaaagtgttgattattgttggatctagaacatataaatccttttattggagtacctatgcttcagcaaacaaggtgcaacttctactttttcatcttgtatccatacaattacgtagagtgccagttttctcctataaaacacagttgacgtttgagagttttattttatattccaatgatccattatagctattatatacctacagtacttgtaataagacgggttattggcgttcaataaattgttcaagagatcttttctgagatcaagcctgtcaatctcgtgtcgcttcatctggctcttgtcacggtgactttgtagtgaatcaagactagtaaatcaatcattaatattataccaaaccatctccaatctcgatgttggttcagattgtttttgtgtcttttatgttcattcgttttctccttttttatattattttaatgattctccggtttttttttttattctaatgattcattaccgctgactaagcatcacatcagagactaacacaagtctgcctttaaatgtaacatcgcacggcccgatggtttagtggtataattctcgcttagggtgtcctaggcaatttgcgagaggtcccgggttcaattcccggttgggcccttttttgctcatcacatgggctgaacagaactttttcgtgatttaattgatgcaattggtgtgttttgatataatgcaattggatttctttcactcggtcaacacggcacggtctactattgatttattgatatgttcgacgatagttcaattgttagtgctattgatgcaccactagagcctgaaacggcgctaaaaaagttcacatgtgtcagagagacgcgttgccgtacgtctctgttgaaacacgtgggtgcagtgtacccctgaatactgctgaactgtcagaacaagatctccgagcggtgccttggagatagagtgtcgaataagcagccatcttattgggcgactggagtgggtgttcgttccgagggctgtcttggaaggattccagttcaccagtttgagaccaacagagccgaggctgggagatgttttgatatcaacatggttaattgtggacggacaatgtcggctagcgcaggttgacggtccaggctgtatccgagtaccgtcgatggagtaaacagcaatatactgcggtatagcgcggtatggcgtacaatagctgttgttctgatggtgctgtacactgtacttgagcggtaacaaagaactcggtaaacacgtggcccagccattggcaacggtcttggctgcttggctctcgtatcacccaacaccgtccaaacagcacacgcgttagcgtgaaactccgcaacggcgagctaacagaatcccaaaggggagcacgaaatgggactattttgggcctgaccacccccggaatgtccattgaagtacgagagaggaatcaacctctccttctcaacatacgggtgtgtttatcgccctgtatgtcgcgtcaattctctctcctgacccccagatctgatacgaaacaactctgcccggtctcatcagatctatagctgtcagatatcatatcatctagcgatgcacgtggtatctctatcgcactaagggccaataagaaggactgtattatcacattccaaagtccttctgcactaaggaaaaggtctcctggtccatgggctatatataccgcaagtatggctcttgacaggttcacagacaccatcctcctccccccactccccctcacactcgtttgaactatcatgaagttttcaaccttcactgtgatcgtggctgccgccctcttcacctctgccgaggccaagaagaacaaacaccagcccgcaatgaccaccatctcccccaatctggtggagattgctgctgcccagtccaccgccgtctccaaccagtttaccgcccctgttgttcccggatgtgcgttcgacaagtactaccagatctggctggagaacaccgactacgacaaggcgtttgagcaggaggatatggcttggctccggggccagggcatcactctgaccaactactggtccctcacccacccttccgagcccaactacgtcgcggctgttggcggtgactactttggcatcaataacgacgacttcttccgaatccccgacaatgtcttcactattgccgacctgctcgataccaagggcatctcctggggagagtaccaggagcaccagccctacaccggtttccagggcatgaacttctctcgacagagcgactttgcccccgactacgtgcgaaagcacaaccccctggtccactacgactccgtggtcaacgttcccgagcgactcggcaacctcaagaacttcaccgagttcaacaaggacttttccaacgcccagatcccccagtgggccttcatcacccccaatatgaccaacgatgcccacgataccgatattgaattcgctggcaagtggacccggggcttcctcgagcccctgctggctaacaaggagttcatggacaagaacctgatcatcgtcacctttgacgagaacgaaacctaccgtctggagaacaaggtcctggcagttcttcttggtggagctgtccccaaggagctccagggcacctccgacgacacctactactcgcactactccaacctggccaccgtccaggccaactggcaacttccccatctcggacgaggcgacgcgcttgccaaccccttcaagtttgttgccgaccagctcaacatttccgtcgtcgactacgatactactggccagttcaacaaccagtctgttgtcggctacttcaacgacgagcgagtacccatccccgcccccaacgcctccgccattggagtggttggaaacaccatttaccagaagattgccgacatttggggcggcgaggtccccaaggtggccaccccctccacttgtcccaccaagattgtcgaggagtctgccatctcttttaacaatgagaccgagtctgccaccccctccaacaatgcggccgagtctgctgatgtccagtccacctctatcgagggccagtacgtcactatctcctccaactgttctacttccgctaacgctactcttcagtctgttgccgtttctaccaagtccatcgccaccgctaccgttgttgatggcgagtacgtgaccgtttacgtcactgactgtcccgttaccaccgtcgattccaatggagacattaccactcgggttgttcagtccaccgtcaccgagaccgtttgtcccaagtgcactaagatcgagactaaggagtcttctaaggagtcccccaaggagtctcctaaggccacctctgttcagacccccaaggagacccccaagggatcccccaaggctgttgagaccccgaaggagtctcctaagaccacttctgcccctcagacccccaaggagtcccccaaggctgccgagacccccaaggcttcccccaaggagaacgattctaccgtgacaatcaacaagaccgtgaccaagacccagtccgcagctaccaccatggtgcccagcaagtcggctcctgcccaggcccccaagagcgagactactcctgcccaggccaacggcgctgccaaggctgttgttggagctgctgctgtcattcccgcccttatggctctgttctaagagataccaatttgtagatttgttaattcaatgagtgagtagatgttccaagtgtgtcaacagtggttctaggaatcattggggagtcacgagttattgtgcagtactctccaacccactaagtaccgtacagtaccatccaagtcgctatactcgctgatattgctctgatgatgaaaagagatcagttgaggatgtctacaagccttatgagagtctagcggagaccctgtgttaatctcaattagtacgaacaaaaaggaatgaaaaaaaggtctgtttcatgtccatgtcccaactaaattgttagattcttgtttaataaacacattcgtaacaaaacataaagtaatgtaccctctggcattgcagaggtgatttggatacaacctgacacattgtcgcctgtaatccaccatctatcctcaattggatatctgccaactgtggctgcttaatcagatgtctattgaggtgtttttcaattgatttttcttgtcttcgctaaatttccactctacacataatatgcaggccgctaaccgtcctaacggtctgcaataatttagtttacgaactaaaaaaacaggctagaactcccgtctggcgcacacggggaatccgagttcaattcgtcgttgcagagactccctttttgctccatatatctaggagtacttttttgggagtacttttgctccatatctttgctcgagagaactttttgctacacggctgaaataacgaagttcgccgtaacgatttttcaattaatttaatttttttatgcaggagtttaaaatactaatattgtcaggagagataggagattttagggtgttgtagagacgctatgggtgtgatttttggtgtgagtgcccacacgacgttccaaatggaatgttccagaattcagcgaaatcgaggtatttctgcgtctttttttttttttctgcatatacattcatttaattataactttgccgtgaaagaataacctttgaaatgaatgtacgcttacacgaatattactaattaaacacgtttagtttcatggtccaacttggcacgtacctatttccagtaaaaaaatcataaaaaaacctggttcagtccgtgttgtatgttggtccacatagcttcgcgtgtttgttcgttcatcgggaaaacgccactccagtctccagttctctaatctcaatccttccattgccctcttcatttgcattgcctttgaaaacgtctccttgtggttcttcttcgtcattggtttggttctgcgtcccctgtggtgactacgcgccctgctacgctgttctctcggtggcctcggccgccttttgcgcttgctactgtctctactctcgctcatcgtgaagtgctggcggttgtccatcgtagaaacacatctgggcttccttcaggaattgaagcaaaccctgttggacatgtcccagggtggcgtcgtcccctgagtaccggagggatctctccatcttccagatcccataagccaattcccgcagatatttgcgtgtcttgacttgttgatgtttccggggggcgtcactgttcacatgccctgggaaagaggggagtactccacatttcgactcggtaaagatccagtcctttagagagttcactgacggaatcttcatcctggtcaacatggaaagaagaacttcgcacttgcagaagatatgctcgtgcagatcctgaatgatggccttatcacagagcccgcatcctggattcttcttggtgaaaacgtggtcgtcagggtatctccatttcacgagcggaagtcgagatatccgcatgaggtgaagaacttgtgctttgttggcgtcggcgatgtagtgttttcgaaggtcatgcattacctgcgtcttttgatacatgctgcagttactcgtttaccatacatactttccagccacactgattgattccgaaccttacatcaaaagacgcgcagcagagcgagcttcagggcgcgtgtttcgccaattgaacgactttggttgatacacaaatacccaattgacccagaaacagctccagcttcagatcaaccgacttacccagacggaaacgacactacagtaatacgtcatcaccgtggccattcgtctgtcccgcaactccaacacacactacaaccagtgctatcatggacccaccggacattgactggctctgtgcacggtatcccagtctcagcgaggcgattgtaactgccgtttgttcggaatacgacacggaacaggaggcggtgcggcagttgagcagtatcaaccctgatgtccactttgactataacgagaacgacgacaacgatgagaatgagatagttggggccgccgaagtcgacgaaatcgagcttgtgcctcccgacgaggacatcactgactttgagaagcggctaacatccctcattatgtcacatgaaaccaaaaacaccaagcctgtgccaaagggtccggctcgaatgaactacaattacagcaagagtcctaagaaacagaatgctcagctttctcagaagaaacagaatgcccaactttctcagaagaaacagaatgcccaactttctcagaagaaacagaatgcccagctttctccgaggaacttctataaccagccagcagtcccaacgtctccccaaaagtcctacgttgcactatctacgcgcaacaacttttccaaggagatttcggacatatctgagctgcttgggttgccttttgaaaaggtcgaacgagtctatcactggaaacagatcaaagcgtgtccccagcgaacgattctggagctcattatcaccgctaaaacacaccctcctaccgcagccgacatggtagtgattgaaaacacgaatatcgttttccagactattccctggccagtcgttgtgcggttgtgtttgtttgttcaaggtaatggagaaaaggcgttccaggttgccgaaaaaattgccgatttcgaagcgtgggactccctcatcattcctgaggtggagggcattgagcagccagctattgaaagtcccgatgcggaagaaccgcaacctacagaattcacacgagtgggagacaaggctagtacggagaaggtgaaggcttccatgtcgctgtcccagcagtcacagcaatacaacgacctgcaacagctggctaaaacaaatctcttgaatactactgaccctgctctacgacacgagttccaaaagacatacaacgagctcaaggacaagaatcacaccgtcaagcaacgtattgccaagctcacagagccacgtaatgagacgccgtggtacacggacttgcacgggttgtatgttcctgaagccatgcaagtggctaaggtgaaggttaacagttggtgggaggtggagaaagacaaggcagtaaaggacatccgaccgctgacgttgaatacgggtctgggttctcattcgccaggaggtttctccaagattaaggtcgcgttgtcaaagtggttgaccattgacggatggatccatgaggttcataagggccatattcaggttgtgaggaggtagcagatcagatgaacgatcaatgtacgaatctcttttgaatgacgtatgttcatatgaatctcttccaaatgcactgtacttgcgacccccttccatccaaatatagggactctacttctaacaggatgatcttccacgaggtgcgagttctactcaatatatactactagagaggtatcttataagttctttgtagtttcatcatgttgcttgagtgtccatcatataatagacacgcattaccatcctatatccactatcaaaaatcatcaacaaacgacacacttcctctctgtacaagtactgtttgaactccgtgcattcttgatccagagacgaacgggcagagttattacgctgtcatttgcccttaacgcacattccgcaactcctgctatcgcttacgctctttctttccacgcttctcttccttctccttgcgtcattcctccagctcctcgaatgcgaagtcagtttcttgaggaagaaccgcttcttgcaagctgaaagggagtcacagtgtacctgatttgaagagctctacatgttcaggaacaggggccaagtacgactcatgccgcaggaacgacaagattgacgaataactcttcgacttgttgagatgagatgagatttggcgtgggacttcgagtcgaaacgtcgacttgacatggtgaacctgaatcaaattgcttcggtcgacacattgtcagaagagttggagcacggttggaagaggagggttcgagtgttagttagggagactttatacgatggaatagacaaggggcagttccaacgctggctctgtggacttcaacagctgaataaatatccatgcagaaagcgtcatcttgtttgaggtaataccacaatgtgtatgcttacataatacgcccggggacatactgtttgacaaactcggtggaaaagcgatgttttttgaagatggaaaacttttctggtactttcccgatagctccagaaacttcctgtgtctgtttcagttcatttttcgccgaaaaaagctcttattttcgtgattatagctcatcgtaatgttgagagaaaaaaaacgcgggctgttggtgtagtggtaacatatctgccttccattcagttgatagcaggtgccaggggttcaattcccctacagctcactctttttgcactcttgatgtctttttgcgtctcttccttgtcggtgggctccgatactggcgtggaatcaccaggcacagattacctggcatgagacatgctggaaccaaaaaaaagtcttgagacttgatttctccatacccacggcgatcacggcatcatcttcaaaatgtcggactcccccgactttgtcagaccacaagacgtccgtttggcctcgctctcccacgcccagcttctaatccaactagaagagaagacaagggagctagctcaggtgaaggaggagctcgccagcacaaagaatctgacgagatatgaagatttgatgaagaactttcgatctctatcagctgaaacgccggagaagatcagaatcacgcccacaaccgcagaacccgaaagcaccaagttgtggtatgttttcgaggatcaagttttcgacaactgggatatggctgttcgtggcgcccgaagcgtcgagagtatcgtcactgtgtactcttttagtcaagccgtgaacgtgattcgccaatgcggctatgatcattacgtccccagataccgtcaagactcgagctatgtgaatggggcaggtcagaagctgtaccgggtctatgtcgatggagcatatgctcgaaatggccagggagggccccaagcgggcgtcggggtgtggtttggccgttgcaaccccatgaacgtctctgagcctctggcgggacccattcagacgagccagagagccgtgctggcggcgatcctgaaggcatatgaggcgattgcaacaatgaacaatggccttcaatatgagatttacaccgagtcaacttacgccattgactgtctcaccaagtggcatcagatgtggcaaaacaacggctgggtcaactccgacggagaccccgtgagcaacaaggacttgatcgaaagcattctcgccatcaaagagagcgggtcttgtgccaacgtttctctaagggttagcaggggtatttaacaaccaaaggggtatctcacgcgattgatttaaccaaaagtgattgtctcacgcgattgattaccagtcacgtgctagaagtgctcttgtatacaagcacgacaattctgactcaattggtcatatacttgtactacgtagacataacaatcaattatctgtactccaagacattaccagcctctagctcctttgccggccaacttatcggcagcgtcattgcctgggttgccggaatgacccttgaccttggagatctcgacacggtctcccagatcgttgagtcgattgagggtgggctcaatcaaatctcggtgctggacaggctcgttcttggaggtggtccaattgttttgctgccagttgctgccccacttgttaaaggcattctgcgcgtaagctgagtccgtcttgacctcgtaattgatgccgtcgtttcgccggtggatggtttcgacagcgtcgtggatagcctccaactcagcccgctggttggtctgtcgcgatccttgcacaggtcgactcacgttgtcgggatgaccaggtccaaagtacactccaacaccagcgcgagcattggagccctggttgttgtgacaggctccgtcggtgtacacgggaactctggcactgctggtgctgtagctggagccgccgccgtagctggagccgccgccgtagctggagccgccgccgtagctggagccgccgccgtagcctccagatccgccggcaaaggcttcggcttcggctcgcgtgtcgaatcgttggtggactccaccgctgtagccatccacctgctgtctggcgtcgtcccaggagttgtagacgccggcttctcggccgttctggacggcgtagtacgattctttgcctcgagccatggtaattgagtcttttgtgatggcgataattggtgtggggtggaagaggaagagcgagaggagttgccttgtggagagaaaagatcctccgctccggttatgggctgaaaagttagtcttcaaaaaataaaaaataaggaagaaatacctttatctaatgagcagaatcggagcaacttggatcacttgatagccgttatttttcaacctttttgcacaaaagtgaggatttgaaccacttttcctcctttttcctccactccctcctttttcctccactccctcctctttcctccgcctctgctccaccttcctcaatggacccatattagcgcacttttagcacacacgtgtgacgcaggagggcgaactttctatatagatagtggagtttgaatgtcgtcgctgaaaggtcgaaaaccgcgttgacatcgattttttccaacaaataattgggaaaaaacaatgtcggcgtcagtaatattgcttagtattgtttttggggggtcttttgagactccacaaggcgtcagcagtcgctagtcaagacgtcagcagccgctcttcaaaccctcgttaactctgatataatccagtcaaacttaatgcaatgcaaagttatcattaaataatgtatatgcagaaagaaaaaaaagcagttcgaaaaaagcaaaagccctagtgatgttataattgatgaataaatgaacttttatgtgacaatagatcgttactgtactcctcgaatctcagtatatttactgcgagagcaagactgtgtctatcctgcaaaagttgtgtctgatgaagggtcagaaattaccagtacaagctgagcggctcgttgaagtccactattggcaagtttgggaaggacagaatccgatcttccaaggcggacgtgggctgcatgttctttcctcagattccagagtccatcggattctcgtccctcgcacagccaatgcccaaggatttcaagatgtggacacatcaggccaagaaagccaagttaagacggcaccttctgctcatggccaagtgtctgatcctacccgtactcgattccaggtattatggtctcgatttgctgcattcgactccaccgtatgtagtaatactggaagaacccccttggatattgcaagagtcctggacaccaaagactcgttccagggactttactaacatgtacgatgtaatgtcgcaccagttgtcgttctgaggtaacacctttgcggatgaggagctttgttttgatgactcaaattaatgaatgtaggcagaaaaaaatatagcgggtaatagcgatacaagtaaacctgacagcaagttggttgtagacgagatccaatagtgtatcagctgatctaatctccttctggtgttgctttggtgtgtgctacttcggaacgtccttagaagtgtacataccgtagaagtgttgtacaagtctttatctatgtatgtactgtatatatatatatatatatatatatagttttctgcatatactttcatttagttataacttttcatcgtcacttttacctcaacaatataataaacaataaacatatatacagctgaatgtattgtgagtgatcttacaatcatgttataaaaattcacaaaaattgaaatattcgcaaaaaattgataaaaatcacaaaaaagacatgaaaagagatataattgaaataatcaccgaaacacaatcacacattctctattgacatcacattgagcaccacctcactgaagtacagtgcatactcgtacttgtacttgtactcatacccctcattgatgtagcagggcgcgtagtcaccacaggggacgcagaaccaaaccaatgacgaagaagaaccacaaggagacgttttcaaaggcaatgcaaatgaagagggcaatggaaggattgagattagagaactggagactggagtggcgttttcccgatgaacgaacaaacacgcgaagctatgtggaccaacatacaacacggactgaaccaggtttttttatgatttttttactggaaataggtacatgccaagttggaccatgacactaaacgtgtttaattagtaatattcgtgtaagcgtacattcatttcaaaggttattctttcacggcaaagttataattaaatgaatgtatatgcagaaaaaaaatatatatatatatatatatccaccaatatatccaccgatatctcactccatcctcactccatcatctcaataatcgacaggggaatcagaaagtggaactgagaaatagggctaaactcggtaaacataagaatgtaaaaaacaggaggttgtttcacacacctttgaaaccgaaatttcaccacctggtgcagaaatgtcggctgtaaacagcctggaaatgtctccttcatctggtattcttcaacatgaccgaactagtaagagtccagcagacacaaaatcaaccaacgcgacagaaaccaaaccaaacaatgtgacagaaaccaaaacggtcgacgccgcagacgcgagaatggacagagtatcaaatgcagaaagccattaagaacttcaagaggcacgattataccgtgtacaggacttcgaagctctgggatgtgccttatgctactttccaccgacgactgcgcgggtctagggccagacacgagtaccaccaggactcacgtatgttgaccaaaaatctagagaacgtgttggaagaatgggtttttggcaggcgggttccggtgtttctgtcactcgcgacgaaatcttgaagaaggccaacgaaatggtcagagagattggtcgtgacgccactcttcagattagttgggtcgacagtttcttttgacgaaagcccaatctacaccaccaacaaactgcaacgatggctaaagatcgtcttcactgcttgattcctgaaatttgtcagttgtacgaagacctcaaagaatacgaagattaccccgactgcgtcgtctggaacatggacaagtcgggtgtggcagaggcagagacaaccaccgaatggaccattggcagacggagttcgcgttgaatcgtctccagtcaacctgctgctcggagatggaccaattttttcgagtgttccaatgctgcaggcgataaaggcactctcgccagaccataagctgctgaacaggttgtcaaggtggacttggagctgtagaaacttcggtggagcaagacaccagcgccagtgacccaaaattcgagtactgtacctggaagaacattgagaagtccaactgggccacagtacacaagctcagttagaagctcttgacttccgcgacctgatggtgatattagttgaagatgctgagtggagtgagttgtggttaaagtactgtacctctctaactcatgatttttgacagacagaagtgatcaccaaagttattgccgtacgaacgggcccttgtggtccgacaacatgccattgggtccagagaggaggtgaggagtgaattttgcccaaaatgttaacccgagtgctccagaacggttctccagagccctcacgaatccaaaatctgcctaaaacgagctccaaacgagctccaaacgagcttcgactgagccataaatgctctaacaacgtgacctagctgcttgtaataaatgttacccttgccgtattggacatactagacacatgagccattatcaaacccatttgagaaacaacgcggtaagtggaggaggtaggaggatgcgctattctgtaaattgagagtaatacgactagttgagaagcatggatttgttttgggggcgtttttctcttagagtaatgtcacagaaaaccacaatggtgggtcgacgaagtgaatgttggtgtacactcgtacaactacaacaactcattcaactacaactactcatacaactgcaagtactcgtacaactacaattacagtaagagtatgagtctgtttgaccatgaataatggcgattcaaagtcccttacacgttccgatcattggttcattatatacatcggatctcccccttcctagtaaacaacagccggtgtcatggtcagtttcatcaacgtttgctcgcgatctgctggaaaatatcattatagaagcagttatgattatattcggcgatatattaagaaacaaacatcacacggtcttgttttgattgtttttgattgtttttttttttttttgactgctttattagtcagcaatattcccattgtgtggacccaactctacaaccgaaacccgtcgcgcgcctggctagctcaatcggtagagcgtgagactcttattcaaagcaatctcaaggctgtgggttcaagccccacgtcgggctcccttttttatatccaccactatcagggtatcagtatgtcgtttgtttactatcggtactgtacaggagcatagtacagcttgtcgaagtacttcaaccgccccaccttgagagactttacagcctagagtatgtgaaaattcagtccaatttttcatggaaagcacctctgtggatatacacagtgtatttccaagtgtttctgctgcctgcgacgattctcaccattctctgagcaagttcagatctaacttatcacataacgtacagaatgtactgtacatacgataacaagcaacttacaagcaatataaacaacctcgttgatactcactcgtctattgctccacctctgctgatccatctattgacaattgtacagtattagtagtaacgtggtacatacggtatactgtacattgtagatattgtactgcagtatcaaagggcttaacgatcgtcataggtttggcagggatacagagctacggacactctcggtgagacgacattgtgcggctctagttcataatactacttacacccataagagacagattggcttgattcgagagtaggatagagacagtatgtacatactgtacagttctagataggcttactatctttggtaccattttccgttcggtaacggcaaaagatttgaggggccattgtcaacattgcaatgagccctttcattggattcatgttgcccagcatttgtttcgctcgtctggaagcgagacccacaggtctggctcttctttacggcttttggcaatgcgacgtccatttggcaaggtcgtttcccagagtaattgatctccctggactgagattgacctttttgcgttgagactttcggccagcagggaaggatcaatctcagactgcagcaccgagtccatggcggactgctgtgacaggagaaactcagactttccagggactgaagtgtcgccgctatgttagtaatcagtggtagttcaatgctggtcctgacgtgaccgacccgagttactcacctgatagatcacacacctatatctcacacacctatatctcacacacctatatctcacacacctatcacacactcacctcaatgttcgttggccgaggtggtggagagagaggctgagatgtgtcattaggctgcgttttgacttgccaaatcaagttgcaacgcgaaatttatcaagtgaaatctataaagtgattcataaagagggtctgagatgagtgagacttcaattgatgggatcctgcagtacttgcacttgttcttgtacgtagatctgggtttacttgtacacacacaagggaatagaaggcagatgttcagtcaagtattcagttacatgatccaactaaattataactactataactagtacagtcgaggggatctcaaacccaccaataagcggtttttagagcgaatcaaagaaacaaaccccataaaagatgaagaaagccttcgagttccaccctccacttttactttatcatctcacctacacttgtgtcgagttatgtcgacttgtgcggagtatgtcgagtatgcaataaaattggcatatagaatatgttcactagatcctgatctcttgagctcacctggtgagtaggtttttcttccattttatgtcattctactacgttttcaggttttccattgtcttttctatgattttttatttttactctctagtaagcagaaattggatgctgaatgatagcactcttccaaatctgtaactaatcggtgatgggtatatcgtcaatatatccctagatacgaagcaggaaccggccatcctactctacagagcaatacaccaatagtacgagctccggaagtcgtataaacataacttcatacttgcgagtggtggctatatattattctaatgattcattacagctatatacctagtaagccgggttattggcgttcaataaatcatacacttctgaatctttgcggtgtgcgctgcgaggcgctgtcggttggtttgtcgacgcttcgcctggttgatgtcattgtcgtggtctcgtggtggtgaatcatggctaacagatcaagaaatcatatcaatcgtttcatgtcttatccagactcgaggttggtttagtttgttctcataaaagatcgtagacggatttttcatgactaatcaaaacaccctatgactagcttctgaatcgttacaaacaaatcaaactcagcgccgatggtttagtggtaaaatccatcgttgccatcgatgggcccccggttcgattccgggtcggcgcagtttggttacggccatatcctggtgaaaatacggcttcccgtccgatcagccatagtcaagcaccagagagcctagttagtattgtagtgggagaccatacgagaatcctgggtgctgtaatcttttttcagtcgcgcagcggccgagttttgccatctttttacccagtttctcatcctgccttcaaatccatccacatctttactctggacctcgcgttatcacgaaattaatttagctctgaaacgcgtcacgaaaactattaactcgaagtgtcgtcgacgcgtcaaactccgtcaaaagacgaccgaaacccgcactcggttcacaaggcccatgtttctgaatcgtctgtcagtcctctgaaatccttgctcatgtgattgctcacgtgaacacccatgctcacgtgaacacccatgcccacgtgagatgaatcactaccggaacgagtctgctcgtcagggagaatccaataccaatctatagagtctagtctccacacaaccagaatcggatcaatcggttcttctcgagctccagatcgtaaaagttccgttccgtcaatcccaccgtgatcatcaactgagctgagaccatatcagccagattatcgacattctcacaggtttagtcagcgaggtgatggagctggttgcgcaagtacaagtacaagtaagtacaagtacaacatattgaaccgagttgcgtgctaacagtgacttctccgtcagaggcggctcgattgctattttcaactcatattgcaacatccaactggtctgcatatatcaaactgtcagatgtcaaacaagccaacatgagaagaagaaatgcaaccaagtgaattgtctgggatattcaaaggtgaataattgcacttgaagttgccaaattgtgcaaaaaatcagtgatgcctgaagaaaaaaaggtcccaccgagattcgaactcgggaccttaagatttgcaatctcacgcgctaccgctgtgccataggaccggattttgagaggagctcgaggttttactgcggtatccgcaaagcgtcaaaaatcatcattagaataaaaaaaatcattagaattaaaaaaaaaaaaactctcaaattccgcaattccagaggatttttgacacattaaatacagtcatggtgattaaacaggttcaagaaacagcatagaaaggctttcacttcaatatccccatgtatcatgagtagttgtgtatggttagaaaatgaaaaagtccgcagaatcattttctgtatggagacttcctagcgcttgggggagagggggaatgaccgacggggctctgaataactgctatctaacttcatacagaaatacagtctctcttaaaagtgaagtattcattaatacagcacgataatgtctaattagaaggagtaccaaattggaaagagtatcaaaaactgcaagacctggagagttgcttaccaacaggatggaggaactactcatcttgacattacaactgtcggtctttgcctcatgtttcattatatcctcagtcagtccattatatcctcagtcagttcattatatcctcagtcagttcattatatcctcagtcaagtcaccttaatccagggttgtcttcttaatcctgggttgtctaatcccgagttgtcttcttattcattctgtcaccatcttaagcatctgtgtcactgtgtcactatgttttccaacacccgccgagaagatggcggcgtcgccagtttcgagctcaatctacgttacaaccagcttttgaaacaacgatatacactgaaatgccaggttcagggcatcaacgacagcaacgacgggctcttgcaccggctcaataaggcttgcgataccagacttgcggccgaaatggagacactcaagaacgttcattgtctcaatcacgagcccgccagggtcgcagttcccgagcaaggagagcccggtttcggcttcagtatctcttcgacccctccaactggtgtttcccccgactcaccagtccgaatcgagactcccgacgccagaacagtggcaaagctcgagctggaggtccacgaactcagcctggagtttgaccggctcgtaaacctcaaccacttcctctccaaggaggtcacgcttctccaagcctatgacccatccattgtccttgtgaggttccacaatgtcacgaatccttgcgacatcaagagatactttctctcctgtcccagagatagcttgatcgacgacattgtcctccgtcttccgtcagattggaatgtgtctctcacatcgcagtttgtgggcaccggagaccgtcttggtgtctttaacaagcccggagcccgtctcaaagacctgcgagggtgggtgagatacctggagctgggtggcctggtgtttgtgtctgattgcacaactggggcgggttctcagaccgcggtaactggagagattccctcaccacctctggaatcagatgctggcggcgattcaaggtctcggaaaagcaaacgagccggtaatgtccccgtcttagaggatcaaccctttgcttctccttcgacctcttcctcggacactggtcgcaagaagagaaaagttactgcgaccagagacaaaaaggtccccttggctagaaagaagagaaaagcggcaacttctcgatccaacccaacaaagaattaatttagaccgtcccgattgtcttgcttgaaacaaggacaacatgctccaacttatctaatgaacataacaccatacatttcagaaacaatggaaagacatctctcggattattgtctctccgtaagtactacaagtagagcgtgttgaacctgtccattctaacctaatgactaccttcttgactcgtgtctcaactactccccgagttttttccgactaacatgcctccttcaacctgaaaccacatacaattgttccggctgaaaaataccagagtcacccccgtgcctttcgagttctcaagaaccgcaattgaagtcgtcagagtaatgagccagagccattgagcccgagccattgagcccgagccgcggattgtgagggactcaagggttgtattccttctggaggacctatcatttccacaggcaacactcctgtttgaaatactcatactcacagggcgaaactcctttgtgaaggtctcataggacgcaactctagcgaaaccatatccaaggtcaacaggcttgtcataatctgcgggaaagaagacccttttgagcttgactcagtcgcctagcatcagactgtgttacgactcattataccaggaaccaatgtaactccttgagttgatttatgactccttgagtagatttaacacctcgaaatggattgaatcacatcaatttcatagccgaaatcaccgactccaaccatcagaccaagcctcttgatgaacatttctcgtctgtattctccttcagggtgccacaactagcccaaagacaccagatatatgtaggattttttttccatctatatactgatgaaaattgcaaacaccgacaacattacttttccagtttctgtccatctccatcacatccgtaccctctccagaaaacagtgttgctcccacctttgagggtctctaaaatcccattcagtgaaacaaaaggaaatgtttttgatcgatactactaataaaggggcgactaatcatctcatgttactttacaagccgtcagcgacgtattttctcgtttttaacatttttaggaataaaacaaaagttcacttttaccaagaaaattctcctcccggtggccaagctggtttaaggcgcgagactgtaatggtaaaattgtaatcttgagatcgggcgttcgactcgcccccgggagatttttttttggcggtgctctggagagtgttgttaactggagtgtgtctgtgtctgcatctatctggatatttccattttatttcattttattattggcctgcataccactgtcgttttctgccaaaatgcagctatacccaaccagcataaaggtacacagtattttgagagagtgggacaggagaatgttgatattttttgcgggaagaatattgtgtgaaaaatatcgaagaatattgggaatattgtttgctctagatgcctgcacgcactgtatattgcttttacagtccaaaatacatgtccggcgcggaagaacagactggaactcgttagtgagttcttggaagcttccaactaaaatccaagtagaatcccgcactctaaccaagtacaagaaagaataacttcggtacaacaacagaccaactacaactcaactacaatacagtacagcacgactacaatattcctacaggtgaaaaagagagtacaatgtagcgtcgacaagatcaaccgcaaggaagcggaatagagtcactggtattatccggaccgggattatccacatgactccaagagtccttttcccaaccgtcctctgaaaagtgccgagtaccgaggtacatgtcgacagaagcatatcgaaaatggtaccaaaatgatggtgtgaacgagccgaatccaactgtgctatcaatgagttcatggcgtcgctgtagattctacaaatcggacttccgggagtcccgtataatagtccactttgttaccgacacggacacattgagagcaaaagtccacccacgtgacaaaaccccgatatttaatttccgatttgaaacctgatcgaacaagcggttcttggtccgagacatgtgctgatccgggagccacagtgtctaaattcacagcaatcattgtgacagataacggttaggcagtcgaaaaatttaaaaatttaaaaattaaaacgaaaaaaagaaaacaaaattctgaaaagtgtacggataatacaccagaaatatacaaaaaacacaccagaaatgaggtataaatgagaaaaaaaataacaaattcacacaataaatgaccaaatagatccaatgcccaccctaaaacttggcacgtgagtatgtgtactatcaggttatcgtgtcacgtgaaaaatttcgattggccacaaaatgccccacaactgttgatccaacacagtatcgtaggctcaagcttgttttatgcataatgcaaacatgcagtgacgtgcataaactgcatagccaatgcatttcagactttcccctaaccttgaatgccacaagaaattggtttaaaaatagaaaataaagaataaatcgagacagggcaggacttgacgggaagtgattgtgtcgttattagatgtgttccaaggaaggagagagagagaaaaattcgacgaaagttcatatacttcacgccgactgtttctacatgtttttattattattttattattatttttaaatccgatttcgtcaattcaatcctgtctccatgacaacacatgactgcagggtgttaccccgccatcttcttggggaagaaatggaaataaatgggttcagaagctatatgggctcacccattttgtctttgtattgttcgtgtctattttgtgtctttttttttttttttttttgattttctgtgtcttttattttgcgaatttcggctgggtttcattttcatgcactttatcttgcagttgcgttgaatatgaattgtagtttcgtgcacgctgtggaaggaatggcgaaaatggggtgaatgcgtgttgctggagtttttcctgaataatggcattctctgtttttctggcattttgctgtttccctggaatttcgctgattttccggaattaattccacaatctccaattctgacttttatctcccgatttttgaatttcacacacctccaaattaaatcgatcgccatttggagctggatatacgagatttccaacaagaaaaaaacaaaaatgaaaccagaattatacgacaaaaatgaaacgagaaaatacgataaaaaatggctggatggacccgacattggctgcaggttctccacagctagagtttcggttggaaaatcgaatggcacaggcatgtgtgagaaaataaagtgctttgtgcgtaccagggatagggtaggtagtgaaatctgagttagtacatcaactctagacgatgggcgtcgcctgtgtagaagaacaataactcacccggtaactaacactatttctcggtggtcaatgcgtcagaagatatcaagacggtccgttttgcgtttaagccgagtgaatgttgcctgccgttagtaaatttattatgaaaaaccccactatgaatacatcagcctatactgatataccaagaagtgcaagggaggtggtcctgttccacctgaacgcggttcccgacaggcggcggtactgaagggctttgtgagagaggtaacgccgattctctctgcagtcgtaagacccaggtggtgtgtccgaggcagtatcgctttcccaactctagtaacctcggtagtgtgagacacactacccctaacggtaggacagccggacgacgatggcgcagcaattggcgaacgctgttataaaacaattcacttacgtgcaatgaatgttgtttgggcaataaacaataaatgtattagagccagacgatagacaacaatccagcagatgatgagcaggaaaattgagtaagatcgacgtggcaagaagagttacagttacgcagagttaataaggtgttgggagattagagttaccctgtcggatgactaactctccagagcgagtgttacacatgcacaatgatttgcagctaatggttaatgcgggaaaatgacaggtatttcgaagagtcggggaggatcctgtcagaataaaaagactctggagatgtccaggggcacgtcacggcaccaactgccgagacatgtctcattggagaggaaaggagaccttttacgaggtggtcggagactgtgcatgtcccgatctacccttatgcagatgcaatgcaaggcactgtacggatgtaatgcaacgcgatgcagtatacaagggtggttttgggacattaaattttgagtggggttggaggggcaaacaatgggtgtgggatctagctatttgtagagtagtcaatggacggtgtgctgcggacctggtgggccatccccatgacattttgtggccattagcggcgggaacaatggcgaattgactggtgtttcagatatttccagttcaggaagattggagacaaggagttggagttggagttggcgggagtggagttggagagatatgtttcctaaggcggggaagtggtgtggttttgcagtttggaaaatctggcggataatgattcctgagttgggggctggttggggggtcgggtgatcatgaatgtggagtgatattgtcgatgattataccgagtgatactatcgaatgatgatgacttgttagtacaataggagttgtgtaagatggtgacgatttcttttaaggattttttttgtatcaccatccagaagatctgtttggagagtgaacagtattattatgacgagacgatgtttacgtaagttgaatgttggtactgtactattgttcggatatgtacggaccaatctagagataccctcaactatcgtaccttacggaccaatggtgttgtcttttggccgaggtggttgtagtccgctctgttttgtcgtcgtccacgtgctagttcgtcatcacactggctcgtcatcatgctcgtttcgtcgtcgtgcttttagttatgtggtggtacttttcgtttcactgacagggctgtgcaccattgacagcaggttgacaggtggtacgaggtgccttggtgagaggagctgcagagggtgttggaaaaggaacggccatttcccgttttctgtccctttcgcccactggtcttctccgcaattggagcgttaggctcttttttccacatgtttctgtcgatatattatcaccgatctccgggaaggaggtcttactgcgcataatatgagacagaatcgcggcgcatcagacaagagacgcatagctgtggggattgtatcatttatcatagatggggctctttgttcatccacttgttgccgtatgactgtttttgcggcccggtgataatgaaacagggtccagtttatacggcgtttcattaatgagagcccgagcgaggggcgtttgcggagtgtttgaggaggtggtcgaggaggcggtttaagatggtttgagagatggttagtggagatgtaaggagatgtgtattggtttgaaattatgttggcgagagcgaagaaacaatatcgtactctggtctgctcactcggtgctcgtattagttggaaatattcagaagaggtgaccaagacgagggaaccaagaccatggaaccaagaccgtggaaccaagagaatcgaaccaagagaacggaaccaaaacaccagcaaaaacaccaaccaagacgaatcgaaccaacaacatgacctaataataatttcagacgcgaaataataaaacacaatcacaaaccccacaccagaaatgtgggttttttccttttttttcccttttttttcctcccccacaaaccgacacgtgacgcctcgaaaatgacccagaagaggggagatggttcgcccagaaccaccatgaaacacgtgtggccaaatgtggccaaatgagcacagacgcagattggtcctagcggatggcccaaacgggacacacaggacacacaaacacactcacaaacagggacacaaaaagaccctgaacacaaacagaccgtggcacagctacacagctacaccacatcatatcgacacagccttgtcaagggtaatccttctccggataggatgagaatggttgacagtggttgacggtggttgatgttgttgacggtggttgatgttgttgacggtggttgatggtggttgacagttgttgacagttgttgacggcgatcaaaaatggttcgagtgtgagaatgcatgtccaagatatctgtgtctatggcacggctatgacatggtccatgtcacggtctgtctctaccactcagctcagttgaccgcctcgctcctcactccttgccatgtcttgtctcggcttgtgtggtctgccttcagatatgctcccaatgtgacgcaggtgacgggatacgacattagccgtgccattgtgcatgatccgattaaagtgtcttctgggttcagaaacacccttcttcgcagctgacagctacgcggaacattggcgatacgaccaaaaacacggttcgggactcgtcatctcacgcggactggccacatggatcgccagggcctcaattggacccactgccatggccccattctcctaccccacccaagcccctccgccaaggcgacaaccagcactttttatttccgtaatctagatccacgcctgcgaggccctgcagcaccgcagacgtgtgcatcgcaaacgcggtggtcaaaaacacaaaaaggcaaaaacacaaaacggcaaaacgataaaaacacaaaagacaaaaaaaggcaaaaaaaaaaataggcaaaaggcgcgtgtcaacttgcataaatggcattaatggatggtctaaagatgaggagttgcagagataggtccatctactgcactcctaaatacccatgaacatgcacagtcgaggatgcatgccgtatagaccctcgcagaccagtattaaatctagacataatatatacggcttgcagactcacattttgtgcatgaaatggcctcgtgcatgaaaccacctcattgttcagatacccgctttgtctgcaatcttctcgtaactctaagtttattacaaactttaaatatacacaccgctggacctgtactggatcaactactcctgttgaacctcaccaccaagtatatattggggctggaccccgagtagaccggtattatttgacccatcacttgcgtttgcattcttttccatcacacacatcacattatgcacagcgaagaagttatcgacatgtgtctgtaccaaccaggcaccgactattatggtagacattatgggggcctggcatatcaggaacatgatgtctacgaccccttttttgacgagtcctacgacattctggcatccaatggccctggtccctacccttctcatgcctatgtgaatgcggaggagtcccatgagctgttggcggattattcggcctttgtttcggatccgaattacctggcccattttactagtgacgagttgcgaagcgacagttccaacccggacgagtatccttctccgattttggagcatccgcaattcgatccttcttgcgagcccgttgactcgtcgtatttctccgctcttccttacacttatggtcagtgcgcccagcagaatttggccagtgccattgacttgattccggagcctctttccaatgtgtcagagacctcagatctcgagtctgcttcctcctctctccccactcctccaaagtcgacccagtcggacagcagtccccctccgttgcaggatcttcaggatattcttcccaaggacgtttgtctagcacagaatccgaatgcgaagcctctgctgccctccgatcccgcttctgttgttgcccagctgtacgcgagccccgagatgtggcggaaggcgtgtcacaccaagaagggcgtcttcatctgcacaaactgccaccacaacggcaagccgctcagtttccgcaccatgatcgagctggcgatgcactttgactcccacggactgatgcgaaagagcaaatgcgacaagtccagctgtccatggtcggtggtgggcttttccacccgctcggaaaagaacagacaccacaagtcgcagcattcggacctcaacttcccgtgccagacgtgcggccgtcggtttggaagatgcgactcgctcaagagacacatgaagctggttcacgacattgtcccggccaaaaagagcttccgaaaaaactcccgcaagaccagcatcactcccgaatcagaggctgaggtcgcctctgtcgctgccccctcgtcgccagtgctggagtccgaccccgcagactcaaaacccaagtctccctctcttagatggaccaacccacagtcctactattcatatgtcacccgaggctgacttccgaggctgacttccgaaactggcctccgaaactggcctccgaaactggcctccgaaactggcctccgaaactggcctccgaaactggcctccgaaactggcctccgaaactggcctccgaaactggcctccgaaactggtctccgaaactggcctccgaaactgatctcctatttaagctaactatacaactaatttatgaatgacgattgaacagcgtcctgtagtcggttgagtgatgcgtgcgacaagtttcccggcaaattcggtgaataaaagattgccagttgggcaaaaaactagacgatcagagatcacaggtcgtacccggactcgaaccggggttattggaatcagaatccaaggtgataaccactacactatacaaccaattttttcacgtaatggttattgatggtatcaaaagggaaagcaaatgatttttccacgtattgatggtatctgaaggggaaacaaaacagattttcgttaaaaaaacgcgaaaaaaacaaaaaacaaaccgtcgctcgaaccaaaaaccgacccactcttttatcttgcttaaatccacctaccgcctgtacaactcctgtacatactgtactgtacacttcctagatgcttccactggaaaccgaagattccccgcccactacccctcctgcctccaaaatgccgacagtgtagatgcattgccgaaacgagaatgtgcggagagactgtcacatgggttgctacgcctcgcggggttcatgtctgggtataacaacgagtcagtgggataatctgggtaggtaacaagacgtgagcgagctttacaacaagtaactactgaacagtacatactgtacctatacaacaatctgaagaagactgctgctccagtattagtctgagaattccatacccgtagtctgatcactccctccccagttgcagtctgaccaacccaataccacctctcgtcagatcggaccattttccactcttttcatgcatagaacatgtcaacgagatctcacctcggctagataagaaatgtgtttgtgataagctcccgttcataggactgtctttgtgtcgatttattactcgtttggtcgttttcggctgcgtttctgcaatgcggagttgcgtctgtttcggttcggttttcggacatgtttccgcgagtagcgagtgggcagccttggagggagtgcggcagaaggtggtggttcgggtagggattcagaagggttcagaagggttcaaatgggttcagaagggttcagaagcgattcgagtggaactttgttagcagtacatcagtcttaatgggaaacgtctctagagtccaactttcggtacatgttgagtaagtgctcctggcatcgtcctaaacgaacatcgtaactggacaggcgaggcagttgactatgcgaccgatagttgattccggaccaataagtggctctcgtagacttgaagtgtgtcctcctttcgacgacggcagttgacactacgacggcagttggctctacgacgacagttgactctacgacgacactactactgactatcgactctctacaaacaccactctaaccacatctgaatggtctccaactcccgctatttccactcccgatattccactattccactccacaaaactctaacacccccgactaccgttcaaacaatagccaacaacgggcgccaagacaaccacaccattgtcctgcacgatctgcattggcactttaacaatgccgtgtttgttgctgtcaatagccgcgaagatacctgcgtttcatcgacgacattggtgaagcgaacgcaagttgcaggccagacagactgcttctaaagtggacataaatcgaaaaaaaccgcccaatgccgcgccaaactgcgccgagacgttcctccagcggccccacatcggagcgctcatagtgacttcccagagcgctcaaagagcattctctagagttgcccaggacctagaacgtacatctgagtcaggagaatcacctggtacttcttgagtctcattttgacactttttgaccatttttccatgtccaaaagtgcagagtcggcgacagttcggcccgacgaaaaccctaaaaaacggccatctggggactctagtgaatgccaatagagagtcgaggcggagtcataattgctcaatgtctgcgctagatgatttataagtccgtgtacgtgcccaagagcgctcccttgccgggctgatgcgcgtgggtcgaaacaagtcatggtccacccgttgttctcatgcaatccaaccaagacaagaacagttcccctcagatgtggactacaaggaatcgcaccgggtcatgtggagggttcagatgtccttggggtgtttcagaccgtagcaaactgatgtggatcagcttggtcgttagagctgctccacagactccgtttgggatctacttgctgaataaacgaacggtagtgctccacccgttgaagtaattaccaaaagtcccactcaatcctcgtctgtcgcgggctcatctagaacacatgactcgatgcatgatacgagcacaggcaaacaagttggctacagtatcgtacagtatgtacagttcgtcttgtatgacgaaacctgcgcgaactccctcgtctaagcccccattgaacaaggaaatcgagacacgcaaagttgctgtggatatcggttgaatgtgcgatagatgcccaccttgcagaagaagtctgtcgctactggaccgtctttgttgctcttgtttgactcaacaaggctcttttgacaagcagcggcagtccaagacgggtctagagtgatcaaagtgtctagagtgatcaaagtgtctagagtgatcaaagcgtctagagcgatcaaaaagcggtttcgaaagtactgtactctcctgagaaggtgattctgccatgcatttatatgatagttagttggaaagtctggtatctgttgatcgctgtgacccatgtgcggtcggtgtgaccaatgtgtgaccaatgtgtgaccaatgtgttgaaccagctaggtcagttgacggacacaatacctgtatgttcacttgtacaattactcatactcatgtcaacatctccgaatccaataccagacatgatcttctcccattcaccaatcaacacttccactcatccgaagagcacaccaagagcggatgaaaggacgctcaaacgtacatttctggcctggaatgcaaacaagagaccaaagaaagagaaacagcagtgagaagttgtccaatgatttgtatcgttgcctttgacctttgtacgaggacagtctgagtgtcccagtgcagtttgtcaagacacgttggacatacgcaaagtgcttggaagggggaggatggaacataatggatgtggaatatacaagtacatactgaacactgtacacgtgcatccatcaatatcgagtgacacgctttctacgttgtataaaacgcctcgtgaagagatggtgtagaagtacagccggtaggtgcaatctcccctaccatcacaagatctcagttgtgctcctacaacagtcatcgctaataaatatccagcgtacagtactcgtacagtacatacttgtaccatcaaacaccacccagaaggacacttcaattcgacatgggactcggattcgtggacacagttaggagggtaataacgacgagatgattgctggttggaaaagtcgctagtgcaccagatatgcaaatcaactgtgcaatactggcttgtatgaaggtcccgtggggtccggttggagacccgtcgctccgtcaccccacaccagccggtgcagtgcacccaaatcgcatcacgctcagtcaagtgcacatgagctcgccaaactgggacagtagagctcacattctgctactctgctctgtccactactctgcactcaaccccatggtggtatcacccagatccaacaacggttcctgatctctcatctcgtacgcatcgagaatcatctcgtacgtctcataatccatttccaacacaacgggacaccgcgaatctcggtcattcacaagctgagcggtttcctcgtcggaacacatctcaatcacgggagtgctgtcctcgtattcagacagcttcgccattcctccagccaccagcgtagagaagacaaagaagttctgaaccgtagactcaaagctgcgagggtcgataatggcctgcaacatgggcagaggttctccctgcttctttcggtagttgtattcgtccgtgagtcttcgtctcatgattcctccgaatcgctgaatgttgtttttggtggtgtcgatctcgttgcccttgagttgcttggcctgttcctgggctcccgtctctgttggcatttctcgcggcttcatctgtcgcaccttttgcggtcggtccttctccagagctccaatcaaatgagacgctccacgagccactcgtccgtacttcataccgacccggcccagagctgcgatccgcttgaaatcaggaacggcctgcggatccgccgagagccccgtaaaagcgtccaccacgcgatcaaaggcagggtcttcagcctcggcggcggcgtcgagaaacctggtcaccatattctgcacttgcttgaggtcaatggtgccgggctgcgcgagcgcgtacttcttgatgtgtttggttttcttggttgccaccgttttcagcagatcggcgtccttgacgagagctcgtcggtcgtccttgtacttttgcttcacctggttggctctctcgattattcccagcacgagttctccatcggcgttctccacgtccttttcgaactcgtcgtagtctgcctgtagctcttgttgtctcgagtattcgtcttcgtcggtcatgttggggttgcaagtacgaagagactgacatgatgttttagccgctactgtatacgcgaaacggcttaatttagctttggacgcgacgtgaccttggaacttgtgagcacgtactgaaccggtcgaaaggtcgtaagttggtcgtaggaacaggtgaatggaaggaagagcgggaggatggcactatatataggttaggacagctttttgtgtcaccacgcagcattcacagctatgacattggctggtagaacgttgagatagactgactaattactgcaattactgtcaataaaaaagtacggcgattctgtgtcggaagagggcgtaaacatggcgataaacaatccaccttgacagtttcttttttcttaatggaccgcttctgttggtttttttttttttttttttttttttccctttagacctgctttaatggatttttcttgaatatatatacctgattgatcaaaatatcactcgataacccgttttctaccgttagaaagtcgtcattagtgaattttcttcaaaaaatcaaaactcggatactacacaacaacagaaatttatacaaagaagcgccgatggtttagtggtaaaatccatcgttgccatcgatgggcccccggttcgattccgggtcggcgcaactcggttacggccatatcctggtgaaaatacggcttcccgtccgatcagccatagtcaagcaccagagagcccagttagtattgtagtgggagaccatacgagaatcctgggtgctgtaatcttttttcagtcgcgtagcggccgagttttgttttttttttccccagttgttacgcagtttcttatcgtgcatccatcgagatttagctggagttttgcggaaccaccccgccgtcgttgcttcttcgaaccacgtccagtacatccaggctttctcagatctcctcctcagtggatcgtgaccgcactcaccaactttcgtcgcattattgctcaagccgatcttcagactcagctccacagactcatcgtcacttcatcgttctcgatcctttctccagagctcacagcgttcatagacattcccgctggtctccattatctcctccgagggttcacagttatcattagcattccaactgatcaccactgtactcgcttccattctcttcgcaagtctacaacgtcaacccatccgtgtacctcctaacatcggtccacttcagtgtctcctagcaagcctcttgccgctaccaagtaaatagccagggttagtagaagtcgccaaggggcgcgagtagcgcttgtaataacatcattaatcatcatccaccaccaaggggactcccctcgagtctgagacgctccttcatgactgattgtttgttcttcctcagactctggatgtgccttggaaactcgaggtatctccggggcaggcctgctctggatatgtccaagaaaaccaagagatgagtggtagtggagacgagttgatagtcgaagcatacgtagttccgctcccttgataattggagtggtagtccttgtcatgagttgtatggcatgagaactacagcattactcgtgactacttgtcgctttgccgatactcgacaacagttatgggtggcgaagagacgacttcggagatagcagcagttatgaagatgatatccgcggctgtgaaaatgtatccacggctatcaaggtcatgtatccgcggctatgaagatcgtatgtgcggcaataaagatcacaagtgtatccggcaactgtcttgatcggacgtactgtatggaacaatgacagaacatttggtaagcttgagaagccccttcgaagcccctttcaaagtctttctttcagtttttcagtctcagtgtctcagtcaaagtgtctttcagtcaaagtctgtctctcggccagtgtctgtctctcagccagtctcaagcctgtctcgccggggcaagattcagattacaaataagccctacgtctaaatccatggctctttcagatcataacccggcttctatagagcgagacgtgggggttctgggtgggggttggcagctcgtcgagagatgagggagaagggggctcacggagagctcgggaaggactcgagaaagattcggcaactcggaaactcggaaacggaccctcttcacactcggaaacggaccctcttcacaaccggtgcgctattatcaccaaccaactaccccttggaggcttcaatgggttggctgaatatcgaatacagttaaactgcgcctcggaaaagtcactcaaggcggagcggaagatggatcttgcccggcggtggtttgcggaaattaaccttgagcggtggaaattgtttgccagacgagctcggtccagggagacgagacccggtgacggagaagtcgacagcaagtctcatcacccgcaattgcgtgcttttcttggctgcatgagattatgcacgccaacgttatcgggacgtacgagaacccctgccacggactcggggcagacgctaggcgcttttacgtgagagatctgaactgcccattgtcagacgattcaaacgagatagttgaaagactattttggcaccatcgcgcttagctaccggcaactacttcgtcagcccatgcacacgtgagaacgttgaacgttggaggtaaaaccaaacgagcccagcatatagtggcggtttctgggtctagagatgacaaaacctggataaaaaagttgtgcaaaatgaaccaacgtgtttcgagaagccgacaatcttcccagatcaactggagcccgtccacgtgtgtcagcaacgtcatgtatacttttcggctccgccctgtgctgagccattattgctaaaaccttgacatccccggacaagtgataaataaccgctgggggaccgcggaatctccttcatccctctacgatcatgttttcgactctgtttttcgcatccttggtcagcgccggcgttgtcagactgcctctgtacgccagagaccatggcaccgtggtgcagggccaccagaccatgggagagtggttctacgaggccaacattctggtcggtacgccaccacaaaacgtgagtgtggttttcgacaccggatcgggccagctctggctcccgggctccaattcgaccgcctgcagagcgggaaactgcacccatccacaagccggctacgacgtgggcaagtcgtcctcctggcgatataccggcgaaaacaaccactggggaggaacaggaatcgtgggagccgaggtggtgagctatgccggccaggagctcgactcgttccagacctgggtgtctctggatcaaatgcgcaacaactacggcatcttcggccacagccctaacaaggacaagcattccagcttcgtgttgaatctggccaagtccaagaagattcctcgggccgtctactcgctcaatgccgaggaggcgattgactaccgggggacttttcgtcgaggaaagcccatcgtcaacaacgtgtactacggcgggttcgattctgccaagtacgaggggcctctgaccacggtcaagtacaagggcgggtactcgatggacttcaccaacattctggtggacggccaaaaaatgaccttccagggcaagaagaagaagaccattttgccggacacgggagggctctctttgcagttccccaacagcacggtacaggccatatccgagcggtatggtgatggccagtacgaccgccttggatggcatgttgcatgtgattcgcagccggtagtcacctaccagtttggaaacaccttcattcccgtgaatctgacctacgaggttcgaaagcaggacggtatctgcagactgattggcgtggatgtggtcagtgaggaccaggagcagttcagcgcgggacccatgttcatttcccgggcgctcatgatcttcgacaatgacaagaagcagatcaccattggcaaagcccggtacacggacgagtccaagattgtcgagttgcatggcagcaaggtcccgggggctgtcaacatcaagaagtacaagaagaagaagtcggacaagaattaactgtatagatataatgatatgattcacgcgaggaacaagttggacttatttaactgtagagatgtaatgatatgatattaacgaggtggatgggttgatgaggtcaggttggacccttgacgagatggcggttgacgagatgacgattagacaaggtgacgattagacaaggtgacgattagacaaggtgacgattagacgagttgacgaggtccgactcaaccgtctccggcgcaacatcgatctcctgtctctataaaagttctagagtgttatatatgttagaaccggaaaagttggactgttctacaagaactgtacatgctgaatgggtagagtatctcgatactacagtagtacttgtaactgacacaagttgtactgtagtcgaaaggacgccgagtccccgtcgactcatttagcccactcgcattggccatgtcgtagttttatcacaactccgtgtgtttcagtccacacactgttcacaatacaaacatctcttcggaaccgacttatctcctggaatggatctactccttacctccactacaatacgtaatgcataaataccattttctaatatcccttgtgtaatttttgtgtgtagacgtccggtcagctcaaaccgccagaggagcgcccagagtggtgcccttggagccgctctgaaaagcaatctctgtggcatcggggtcttcagtaagagccatcttgatgggattctgtgtcgaggtgattcggtcgagctcttctcgggccatacgtcgcttgagctgggtcttggtctcggcgtcgtccaccatctcgtcctcgtcctcgtcagcgttggtcatcacgtccacggactcggcaatcttgccaatgatgttggctcgctttcggctgcccaccgcctggatggcgtcgacgtcaatctcgcccagtcggctgacaatgtagtcggcgtttctcgagttcttcttggcctgcttcttggtcaccatcttagacttgagctcgacacccttgccgtctcgtcgcacgtacgagttgcccttgttcttgttgtgctgccggggcttcttgcccagcaccttgggcttgtggatattgttgttgttaggcatttgtgtcgggttgagtagctagcagaaaataattttcctgctcatgtacaaaaatatttatcatgcagaaagtttcatgtaggtgaaaaggggcgtgttgggttcgatccgcggttgtgcgattttttaaaactcgccattctcgccataaaagcgcccgtgacgtctctcagctggcccaataaacccccatatcgtccgaaatatttttccgtcgcaattccacacttcttctttgccccagcgccaccgctaagatttttcagaaccctatcgagagatcacgaactcaccacttttcaaaaacatacggctggttgtggtttcttccaagtccgtcaaaatttggaagctcaacgtcaaacctgctagcacggccgcaagaccgtttgcttttctatacagaacatccacccgcctaacgcgcgcgaagctggaacgtcgcaacatgaaggctcaaagacaggctgaacaaaagcagaagaagaaggccgagaagaaggccaagggcgtgctacccgacctgtcgtcgacccagtctctgtacaacttcatgagctactcgtccgatacggcggggccgggagtcacgctacagacaatgaagggagagaagtttctgtttggacatgtcacagaaggaacccagagagcgattctggaacagaagccacgagtcaacaaaatgtccggcatctacctcacagggcccgtcacctggtccaccttgtccggtcttgccggcttcctgctgactctggtgggcatgggaaagactgatctggacctgagatcgtgtggtcacaacgtcaactggttctgcgccacctggagacactttgtgtttcacaagaccatggcgatccgaaccgacagaatgaccaagggccacgtgaccgacgagatcaacattggcggcgttctcatcacccccaccgagtcacggctgcaacaggaggagcagcaccagaacggagagaagctcgctccccgaaaccttcaaccgctgcgaagggacacgccctggactaacgtcaaccgggtactcaagaccatgttcagctcgcgaggcggagactacggatacaaccgcaaggagttgcagaagcagtcggatacggcgctccccgcggtcgatttggacgagagatccacctgttacattgctcagttgcaccaaaagaagggcaagttcaacgtcgaggctgcaaatgctcttaaggttcccagatacgacttcaagcagttaatcgcaggcaacaacgtgactttggaggacggatcggtgatcaagcccgagcagtgtattggtgaaccctccaactacggccgaattctgtttctcgacattcccgatgctcgctacgttgatggtgtcatcaactgccctgagtggacccgtaaatacaatactcgagacgcccagccggtgtatggagccggtcagaagcgcgattcgggcgagatgaacgaggaagtcaagactcccgatgtctcaaatgtgctcgagcccttcgtttccacagtctaccactttttcggtcccgaaatggagtcctatttcgccagcgaccccgaaaagtactttgagtggatggagtcgttaggcagcaacgtgatgcacatcatttctgctccctggctcgacccccacgcactgaccttccggggttcagccagtttgtgttacaaacttcgaaacatcgtgggagatcagttccccttgcatggtaaggactaccgaactctgagcgaccccaaggcagatttcttggcagatgagaccatccagaatcgattcaacatgcgcctcttgactcagggtgacgctgtgtctattgaaaacaccacaaacacttctcgggtcgtcaacagtggtctacgtgagtatgaagggttgggatacactccggaggagacttcagtcgacagaccgcttcgaaacgatgatggtactctcaagtgcaaggcagagctgctgacactgggaactggatcggcgtgtccttctaagtaccgaaacgtggctggactgatcatgcgagttccccgagctgacggctctttcactggagttgttatggactgtggagagggcacctacggcactctgacccggatgtactcgcccgaagcttgtctccagattatgcgggagatcaagatgatctacatttctcatcttcacgccgaccatcatctaggcactcccaccttcatcgaacagtggctcaaggccaacccagacgagactctgtctgtggttggtccccagtcttacaagcggttccttgaggagtgtgctaatttcaccccggaaatgcaagctcgaatcaggtactatggttgctgggcattcttggaaaagcacagaaagatgtctgccttgcccgaggttcctggtctgacctcgattaagacgtgctgggctcatcactgcgagcagtctttctgtgtcgagttcggctttcagcttgatgacagcgagacattcaacgttgcatactctggtgacacgagacccatcgaggccttttcggagatggcccgagactgcgacctggtcattcacgaggctactttgaacaacgatcttcccgaggaggctatccttaagaaacattgtaccttttcggaggctctgggggtgtgcaaagacatggaagccaagcatgtcgttctcacacacttttcacagcggtatcccaagttgcctgagctttcggcgttgactctggagacgaaggatctacaaaaggtgccagtggccattgcgttcgatatgatgcggataagactgggcgagattgccgaacaggccgaccattttgacgccattgccaaggctctggaggatggagagcggggcgaggccgacgatgttcctgcatggtaaaagtggaggaaaaatgaacatagagagaattagacggtcatatcgagtgaaaagatatttttacatacaggcgaaacggaaacagccactttgttatttcaagtggatgctgaatgtgttgaggattaagtggtaatcttgggattgcatagcatcagttctgtgtctcgcgttcttttgcgacagtcgagttcaagacacgagaaaacaaaaaaaaaaaaaaaaaaaaaaaaaaaaaaaagcatttctaccacaagcttagtcaaatggtttctccgactgagagttcctgtagaataccacagcgtctccgtttcggaactcgtctttctcgttgcgagaatagtgccatgacactgtttaagagtcccgccaggagtctttacctgttgggtttatccgtagttttgccaaagtaagactggtagagggtgctacggttgccccagactaagtctgcttcaggacgttcttcaggacgttcttcaggactgttgtctttgggcccgtcgggtcggaaacgatctatgaggtcgtcagagtcccaagggaatgcatgggacctgagtcgcttggcaggccggcttgcctccacacttccgtatctggatggaatctgagaagcttcatgcgatctagcgacagctgagttgattattgtcttgggctcagcactggggggttggtttgttgtaggcattctagtgctggaagctgcagtagcagcacttgtaatagtgtgggatgtttgttggggagcagattgcgatgggggttgcgatgggagtcgacatgccgggtgcgatggagattgcgatggaggttgcgatgggggtcgagatgcaggtcgagatgggggttgagatgcaggtcgagatgggggtagacatgtcggttgcgatggagagtgcgttggcggttgcgaaatgccggtgtgactactacatgtaggtggaattgtagtggtcaagtcggaaataccagatgtcccagtcgaggtggtacactgaatcggcgttgttcgaccagcaatggtagtagtcgcgggtatcgtgtcaacagcatggttcatagtatctggacgagcagcgcagaccttgtccagaaactcttcggcatctcgaatggcaagatgcatctgtctgcgttcttttttcaacttcttcttttcggtctggtctgttgttttgctcatgattgtacccaagtgcagtcgacggtttatgaggttgtcaatggaagcacggagcacgtcggcacccggagggactgcggcagagggtcgcacatgggctgcgggagctgtgggcggaattctgcttctgcgtatggcttctcgcagagcaatggttcgctcgacgagagcttcattcattgtacgagtgttgccgccttctagggcagggggaatggatggcggcgttccctgggacaaggtgggggaagatgggtcgagaggaggagcaggtgatgcagagggtatggaagcaggtgtactgcttcgagacaaggacgctgctccactgctagggggaggtatggcggagctataagatgcagctgggcctgtacttgagcttgcagtttgagctccgattggtattggtggtaaagatgtacccgagggcggttgtgtagcagcaacaggagcagaaggagtcgcaggttgttctcccgaagcactccggtccgagtctgagacagctacagccaaagtggcgccggtgatggatgtctgcggtgctgggggtttatcagttggtggagatttatcgcatgtctccgtgggagcgttcatgggcgccacaggggcctcctcttgggtctccatgtgttcaggcacaaacatggtctcgaaactatctagagagtcgtactcgcccacccactcaaactcttcgatgttgtccacgttcagcagggcgttgcatccgtccagtaaggacacattgagtcgtcgaaacttgtcgaggttgcgttgcacgaaaatagccaggccgcgcttgtcgcgtttgatcctcagagtgctgattcggtccagggtttcggagaacagcgtcctcacctcgcgtcgtcggcgcagtttgaaggtcttttcgatggtcgtagcaatgtcgattggctcggagatgcccttcagcatgtcgcctagctgggggtctgtcctggtcaagatgtactctttgatcttgcgcgatacaagtatcaacttggaagctgaggaagccggttgcaaagactgtttttgttgtttctggccaccactgttgctggctcccatgaagctagccagccgaatcagcgtctcgtcggtatcgttgtcgctgatgggacacaagacatgtcgggctgccagggtggacaccagagacaccgagcaccgcttcagccacagcgcctcatttcccagagtcgacagatatgcgttgagatcatcgttgaactccaggtattccgcataagtggatttgaagcccagcatgggatagtgtgttgtagcagttcaagatcgatctcgtgtttaggtagaaaacatgtatcacgtaaacagactatcaattatataaatggtgtcaatatttggggggtagtgagtggtaaagccttccatcaacagtgtatatccaagtaacacttttttgtgtacatactggtcatggtgcatcatctgtagtttttcattttgtatttttttttagttttttttttcaattttttttttcaatttttttttcacaatttttttcttcatattttcttcataattttaatcataattttaatttgccactaaaacaacatccggaatcgaacacacaactctttcttccctgaagctatatggaaaatctccaaccctaacccgcgctctaattatttgtctacatagtagtagtggaagtacagtcctgtaccaatctaccaaccacacaaccatcatgtcgtacaacaagcgaggacgagatgacgatgacgggtatgacggcgggcgacggcagcgacacacgcagaccacgcaccagatcttcgaccggctgtactttgacattgtcgagataggcgacccttctcgaatgtctctgacaaatcgagttgctcaggcgggattcggatttgcgcaggatctggacaacctggcgatccgaaacggagttctcgagacgttcattgccacgatcatggagcagccccacaaaacaccgctggttgcagccattgttctcgtggccaactcctccaactcgctggcaggtcagctggcagtggagcatctgcacagcaagattgaaggatggctcaagcagggcaactataaccacgtcaagatagccgtgcgacttttggcgtgtctcgaaggagccattgaggagggacgaggagtgctggttttcctggatcgactgttggatcgagcaattgagcgggaccaggccaagggtagcgagtcgcgtgatcccctggtggaggagctgtacgccaccatatttctgactcttccctacatcggatccactttggtgtctctgggcaagtctgtggaggcctgtgatcagctgctggagaaggccaacggtcatttcggtatcgaaaagttcctgtcgaaccccatcgtcgagccctacaccggcgacgacaagccctacgagtgcgatctgttcctggccaacctctacgagggagtcaactccgtggccaaggacggatgggccgtcaagtcgttcatcaacgtgttagaactgattgagcctgtggtggagaacaaggaggtgacccagaaacacgttttcccggcagtttctattcccgagactctggccgagtccacttccacagactacatttaccccagaatcttcttccgagcctacatgcccattgacgtggaaggcgaggccatgaacacggttccagaccccaagtcatacgacgctgtgctgtggagagacatgctgtcagacaccatccagaatctcgactttaaccgaaaagagtgcgccaagcagctgttcacccttgatcttttcctcaacaagggcaccttcacgggacccggaatctcggtagacaagctaagtggcaagtttttggatgccaaggccgacgacagacccatctccactctcaaggtggaagacgtggcgtctgaagccatcctggcagagctttttcggctcgccacacctcctctacagcctgcgtactttcattctctgttcatcgaggcatgtatcatggcccctcaggccattgcccctgttttcggccgagcggtgcggttcctgtttgccaacctgcggtcgtttgacacagagctaatccaccggttcctggactggttttcgcaccatctgtccaactttggattcacctggaagtggcaggagtgggtcgagtacgtcgatctggaacctctggaccctcggctcgtctttatcaagcagctcatcaagaaggagctccgtctgtcattcgagtcgcgaatcaaggagactctccccgacgaacttgtggtgtttgtgcctactgacggcgagttgatgccaacctacgagtacattgagtctgagaaccagtacagagaagtcgccgaccagttgttggacgtgttcaaggacaagtacgaccagggtgtctccgagacatacctcgaggtgattgattccatcaaggaggctgtccccgacaacagagagctcctactggacattgtcatcggagccgccatctttgttggctctcgatcactgtctctgtcccaggactggattaaccgtcttgcccagcagctccagcacgtgattgagtctgctgaagatgagtctgctgccgtgacaaccgtcatgcagttttaccgaaaccagccccatgtaggaaccgttgttctgcactttttgctgcttgaaaacgtcatttcgcctgctgctattatcacctggctgtttgagtcgccgggcgatgttgttttcaccgagaaccacggttgggagtgtctgattcgaactctagatgaggtggcccaggagggagaggtgcaggatcacgttggacccttcaagagtgttttcgagtacctggccgtcaaggactccgactcggagcagctcggatggtggaagcgacaggtcaccaagtcgctcattcgaaagtacgttgattacattaagaacgagcagattctcgaagtggttcccaccaatgtcaaggacattgtcggccagtatcttgctgttcgacccattgtgccccggaagaaggtgatcatcgccgagcccaaggttgaagaggatcagcccatggctgacgctgctgccaagggtgtcaccgaggccacctcggctgtcgaatcaaaggagaccaaggaggctgaaaccgctgccgagtccaaggaggctgaggtcgcagagtccaaggaggctgaatccgctgccgagcccaaggatgctgaggtcgcagagtccaaggaggctgaatccgctgccgagcccaaggatgctgaacccgctgccgagtccaacgacaaggacgagacaatgcaggaataaaacataggtatgtaattgtaaatgaaatggattggatgggtttctgtgagtttttgtagtgctcgtaggacatcgtattcagaaccaaaaagtacataccctgctcaatgacacaactgaaaagtactcgaccggagcaaaaaagtcacatgaagaacacgtggatggacgacaccggaatcgaaccggggacctcgcgcatgctaagcgcatgtgataaccaactacaccagacgccccttgtgttttctgtgagcccacctaatgtgtgtcaaaacaaatgttgccaagagactccccaaaagtgacccaaaaacgaccataatttgcaccgtcagatactggtggatttaaaaacatcctaataattgctattttgtcattatgttcatttctggggcgtgatgggagaaaactgccattttagaccaaggtggagtgcataatacatgcataatcgacgcacataaaacgggtttttgataaactctaaatttggcgtcttagttccacatctccacatgtcacacaacggggatgatcagacggcgaagatacgtatgttttctgctcaaaaaacttcagcggtaaaaaatactgttccatgatgttccacgacattccacgatgttccacgacattccacgatgttccacgacattccacgatgttccacgacattccacgatgttccacgacattccacgatgttcagcaacttccacgacacgcgatactcaacgacatccaaccacttacacacgtccacacttctatgagcgttgccatttgtcaatgagcgcagatatttgtcgataatatcttttgtgagttctcggacgtgtatctggttgccagactatccacacgttggtggttcaattgatgtttcctttgatcactagatgtcaatttacattgtgactatcattggtgattcatactcgcgttcttttgttggaataatgctgaaatgatatttgagagtttctccctgaagattaagaacaattagagaaatggaccggaatggcaagcaactcatcgaagaataacggcaattggaaggacaataacggatccgatagccagtctggagtacatactgtcaggctggactggcaactggaagactggggagagaggggaagtccgccaacgctgattgaacagtatccagatcccttgcctatctgagattcattcaacccagatccagtctgtggaacattgcgcaactgtgctagtttttttttatccgatcagtggagttaggtcaggaatgagacaccgttccaggtgacgatggatcctgtgactgaggttgccccgcttacaatatcagtggctgcagtaatataaacagccacggttctgagagggggaaagtgcagagacagcgtagacgggatacggtctttcgtgactggaaacactctcatcctcaagccctccgagcaagccaagaagctcaccatcaaaagtgactttgaaactgacgcagatctggcacatgtcatctccccgcagccaaggcccgattccagtctctgatcagtctgccatcaacgagagagccaccattctaccctactaccgaggatagcactccggcaagtaccccaaaagtaatgtcattggccccacaatcatcactggtatcaagcccagcacaaagtgctacgaccaattgattttcgtctccgtttttgttgtcgtcgataccaccgatcttgacgatgccattgatgtcatcaaccgaaaagtacagcaacggtgctaccatcttccacccgagccggtgcggcaggcaacaagttccagagacagatacaggccttccaaattggtaccaacgtcgccatccctgtgcctctcgccatactctccttcaccggaaacaagggccccacataagttctacggcaagactggtatcattttcctgacccagaacaagacctggactacccagtggttaccaccaagtggcgaaacaaagatgtcaccttccagaagattgatgtcaccgaatgtgcaatgttgctggtgactccattaacgatggcctacagttgaacatgtcgagagtagatggactgactgtgaaaagtacttgtacagtacacgtacgaatgtgattgaaatacaggaagcaagtgcgcttacttgtagctacaacgccacaccagccaggcaatgagaaggtgagaagacatgacagagtacgacactgtagtttgttacttgtgccgttaacatgagtgtggaacaaatcaagtgatcttattgttgctagggtccattcgtcacggcgtaagtggttaattgtggtggatacagtacgactgagatgttttccggacttgtgttcattttgttgtgaattttgagtgtctcaacaagggattagtttacctaatcgctcctccaacaaatcatccactaaatatcttaagtaaatgggggttgaaaaaccagtctcttgagagaagtcttttagaccgttggattttggactattggatgaagagtatctcaacccctcaccccggtgtagatcatcttgtcagtgtctgaatagaccggttagttgatctggtggtaggtatctgcgatgatacaagagttgttttggggcatcatgtaagctacatagatgacgatactacaacaattattttggtactatataatacttggtaaatataaacactttttgttgtataatacaccttctggtgaatattttgtatttttcttctttttttaaaaaaaacatttcccagaccaaaattcctcttttgctctgggatcctccctcatatactgtaacgatgagttcctcgttaccacccacctatttcgtacttgtactggactacagtagcagctacccttctatacttgcacacttgcacctcatgggttactcattaacaaccccgacgcccatcgtgttcaccgacttgattccttgtgtgagattccctcaacaagtgctcaagaaagcctcgtccatctcgaccctcagtctcgactttgaaccgctgttcgaagacggctgtttgaagacggtcgactgctcgttagagatgaagaaagttcctatccggcgacggagagtgtcatgccgcgcttgactctcacaagaaacaactttctcaacgcctcgttcccgtggagagaacccagtagtgtgtttgaggtgaaacaggaacgcgaccatctgagcaacctgctggcgctggggaagggctgcagagcctacgaaggacaccgaaagcggttttacgtctgccacgaccggcttggacgctgcattctggtccacaacaaaaacctgtactctgcgttcgagtccaatctccacaaccagcagattgtgcatgtggcgattctgccgagcaccgccgtgatccatgtgtcgtcggaagagggcgtcattgaagcactgattgtggacctgaccaaaaacggctagtcaaaatcctctccttcatctacttcaacccggccacctgcggagtgttccagtatggagaagtacatactgtggctttcgtttggaggattgtcgattcgggtggcagtcgactggaacgccaacctcgaatgtctccatggcaacatgatcctgggcaagtgttcctggtccgtcggcccatctttgggagtctttcccatgcaaggtccgggagcctgtgtcaagatgtaggatgtacttagaccggacccgtgtctttgatctcgagacggaaaagatgatcgtctacaggagagaagctcatgagcagcaccttctgagaggtactcgccacggtcaattcggtttcgggtcttagatgggtctgtttcgcagacatttcagcaactgtggttgcagaacttcaagacgggaaagaccccggatcagtggttgttggaggcagcttcgtaaccaggttgtcatgtcctctcaaactcagaccactaggaactatccgtattgacaaatgaaagcggtgtttccctatacgacagtgtgcatcttaaaacaatcccagaacaaacaatcccggaacaaacgacagcagcacacgagcgtacaacaccaactacgctctctggtgctttactatggctcttagccctgactaacctgatggggagccgtagtttacatgctacgatcaggtctagcgatagcaccagtgaatgcgactccatcggaagacacaggagcgctagtcacctcgagtaagatctaactggcgaggttggtaagagactgagtgccagtacaggtatgtacaaactgcacagaacctgtggacacgaatgacattgcctcgtaaagcacagaggacaaaaaagtagtgcatcaagcagctgtagaggacgacaggactcgaacccgcagcctttggaggacgtcgttcacaagaaccgaaatccaatgcgctaccattacgccacgtcctcaacttgttgtcgtcggagaagaagatagcagatgggttctgagtttcgatcctttgaatcattagaataaaaaaattttcttttaaaaaaaatccttatcttgcatccaggacgcatgaacgctggaaccatatcgcttggagttgtgtcatgagaagaccaggctgtgaatcaaccgtcgtgtgacaggagtatcgttaatgttaccaggataccagcaatttctcgagcaaatgtcgtcgcacaagatgagtctagtgatgccaaaagcaagcacccctaccaaacatgacatatgtgcatctcagaaacaacggcatcatcgtcttactcagcacccaaacacaacagacacaggtgcagtttgggtcatctttcagaagtgctcttaataccggtattatatcatctgatattgagtactctggtggaggttaccagtatcagggtaattagcactgatatggcgtcagcacctggttcacagttgactccatttcttgaatccatttcgtctgatgatctacaggtgctgaggccatgccagttgaagtactgtagctccattgtcaccagtccaacagcaagcaagcgagactgggcaatggcagtggcgagatcacgacgggtataggtgtatcggggtcagcgtcagagtaagcgattgcggcagacggctgatggcggcggaagtctcaattgtctggcctagcaacctgttattcgtccaatcggcaggtgtaagctgtgccgaagtttctggaagtgttgatgatatggaggagagtgtgaagtttttttctgcgtaatacattcattaattaaatttcacttgggaagaaaagtagtgaaagaatatagttaagtatatcagctagttacttagagaagttaagtaagatactgacaccaactaaattaattttttatttttatttttttttaaaatggacacccaaaattttaataacgacgtttcttgttcctctccaccacactatgtcaaatcgactgcggagccctcgtgaaactgtgcaaatctgatctggatactgtaaacgtgtcagattacatacaaagagacggcggcttcgaaaatatcaactaccaaccaccaatgtgccatttgcatctgctaccgtctacattcggtcagggcgagtccctttctgagctacactacggttgttgagctacagtacggccttgagcaagtgaatttactgactttgtcgagaacacagccccgatgcgaccattacaattttatagacatcttcaaggccaagacgactctcaatcgatcgctgcagccattgcgctatctggatcagctacagtatgggaaacatacattcattcattcaacaatattaatacagattatgaagggctaagaggcaaggcaagaccatggcgacgccgacagttagtctggagccagcattggcctgggtgggcttaccacgaccagaagtctgagcagaacgagctccagtgacaccgacttggtcaggggtagaggggttgacaaatggacggggggagccggaggaaccagatgagctgcgagagtcggcagaaactccagagccgacagaactaccaaggctaacagaaacagcgaagccagatgtgtccctggcggatccatcagagctggaggctccctgtgagacgctcaaagtaccgctagcagtgtcatccgattttgtccctgtgctcgtctttgtgccaattgcatttctgccactttcggatgtcatgtcaaaaattgtggtcaccgggggtgtggttccgggaacagttccagtgacagtggtttccgatacagtctccttctcaaaaacttcgttgttggtgtttgaggttgccgtgggccccgataccgattttttcaagacaaaagcgctggtactcagttcattgaactcatcaacggagtttctgagactagttgttggtctaggagccacgaggacggagtcgacaccgttggtggaggatgccatagtggaagaaacatgtgagaaaacggtagcctgctcaaaaccgactctgctggggctcgtgtgcatttctatcgcagcgttaatgccagtattattcctggtagcgactggggtgccagtcacatacacaaagggactaccgctggtgtcattgaaaggcttgacttcttttgtggattccaaaagggcggttttggggtcgacatagatgatatcagtcgggggagtcgcagacaacgtgacatttgcagctgttgggactggggtgctaactactccgttcgactttgacagtatctccgtgtcgaaaagggatcctaaaagagagccggtggaaactggagtactactttcttgctccacagcgtctccagtggtgtcactgagggtttcaccttcttcggagggtctgaaaaagatgatggaggggtcgacagcagatgaagaagtatcatttgtggcagatacaatgaatgtgtcattaacatgtgtccaggaaggaacgctagttgacgagatgctacctgccgaggcagaggcagaggaggttgcattaatgatggtaaagacaggaaaactggtgacttgctcgaaaaaatctccgtccgagttgataaggatctctgtgccgacaatagatccagaaacagtgttggtggagattggggtgcgtgtcacttgagcaaacaagtttccatcagtgccagtgaggatctccgtaccttcactgtatcctggaacaatgtttgtagaaacaatgctacctgaggagtaggtcgaaatgatagaagagcttgcgaccctggttacctgctcatagaaatctccatgtgaattgatgagtgtctcagtaccagcagatgttcctaggacagtgtttgttgagaccatagtgagggttacctgctcatagaaactgccattaccatcaagaagggtttctgtgccagcactcagaccaagaacaacgtttgtggagacgggaacgctggtaacctcctcataaaaattgccatcagtgttttgaagagttgcggtcccagccgtgtggcccggcactaccgttgttgacgctggcacgacattaacccgtacatagaaaccgccatcagtgtttcgaagaatggtagttccagctctgggacctggaaccacagttgttgacgttggaacaactgtgatctgctcatagaaactgccattacggtttatgagagttgctgttccaccaatcgaacctggaagggtgttggtgaagacaggaacattggtgatttgctcatagaatccgccatcaggatttcgaagggtcgcggttccagcggtgaggcctggcacaacagtcgttgatgtgggaaccactgttaccatctcatagaaacttccattgcggtcgacaagggttgctgttcctgcaatcaatccaggcacagtgttactcgagacaggaacactggtgacgacttcataaaagccaccatcagcatttctcagagtcatagttccagctgtgtgtcctggaacgaccgttgttgacgtggggacgaaggttaccacctcatagaaactgccattgcggttgacgagggttgcagtgccatgaatcgatccaggaacggtgttggttgagacagggacactcgtgactcgctcgtagaaaccaccatcgctgtttcgaagagtcgcagttcctgccgtgtggccaggaaccacagtcgttgatgtggcaaccgctgttaccacctcatagaaactgccgttgcgattgacaagggtcgcagttcctggaaccaatccaggaacggtgttggttgagacagggacactcgtgacgacttcatagaacccaccatcagggtttcgcagagttgttgttcctgccgtgtggccaggaaccacagtcgttgatgtgggaaccgctgttaccacctcatagaaactgccgttgcgattgacaagggtcgcagttcctggaaccaatccaggaacggtgttggttgagacagggacactcgtgacgacttcatagaacccaccatcagggtttcgcagagttgttgttcctgccgtgtggccaggaaccacagtcgttgatgtgggaaccactgttaccacctcatagaaactgccattacggttgacgagggtctcagtgccatgaatcgatccaggaacggtgttggttgagacagggacactcgtgactctctcgtagtaaccaccatcgctgtttcgaagagtcgcagttccaccaatatggcctggcacgaccgttgttgacgtgggaacaatagttacctgctcatagaaactgccattgcgattgacgagggtttctgtgccagcgatcaaacccggaacggtgttggtggagactggaacactggtaactcgttcgtaaaatccaccctcggcgtccggaagagtggcagttccagccgtattgccggggaccacagttgtcgagtctgggaccacagtaacctgcccatagaaatcgccatcagcgttgagaagagtctcagttccaacaatgtgaccaggcacgacatttgtggagacaggaacgagtgttatctgctcatagaaatctccatcagaatcaacgagggtttctgaaccagcaatcaaaccaggtacgctgttagtggagaccggaacgcgggtaacctcttcatagaacccaccaccagatttgggaagtgtggctgttccggcagtggggcctggcacgatggttgtcgagtcaggaacaactacaacttcatcatagaagttgcccttcgaatttaccagggttcgtgttccagcagtcaatccagcaacagtggtggtggaaacaggaacttttgtaatcgccacgtggtaaccaccaccgctggcgattgtggtggttccagctttggtaccagggacgacagttgtggcggtgatagaggcaagggggatacactttcctgcagggggccaattgttgaccaccgtgatatgctcctgggtctccttccatctagcagcctgctgggcggcgtacatcttgtacacctggttgatggcttcgttatactgcgcaagagtgtacggggcagagccagatctcgaaagccaatatttaatggcataaggatcacgcctgggggcaaagacactcagaacatcgtaccaatctggggggtcacagaaataaggatagacgtagtaggcaaagtcctgctgcttctggagatcctccagaacaaaagagtttccgaggtttcgggcgtcactcttgatcttctcgctgtcaacttttggcgtgatgtttttctgaccgttggcgttagcaacctccttagcagcggccacaagctgtttgatcagatcatcagcatcctgagtcaatacacgaggtggaatgtgttgacggatgttttcgtcaccggtgatggtagcatgtaccgtggtggcgagcagtcctagcaagacgtaagatatcttcatgacacactcggtctggggggttaagttggtggtctacgattgtcctcggatttggtacagtatatatattcgactatgttcttttgtccggttacaagagacatccagagtttgggatttgcatcgacaacctgctagcacacatttctgagccaccataggaaagtgtgctgccatacaagtgagccaccatccagggaactgagccaccgccagagaattagccaccatacaggaaagtgagccacaaaacagggaagtatttgatgcccaagaggaaccaccttcgtcgcatgtgttctggcatctgattttgtctcatgttgatacctcgccactgcactacgtcccgcggtctaacgggcaggttgctgagtccaattccatgctaagggtgatcgatgcacaaaaaaagagaactttaggcccggttaacagaaataccaggaattcaatggtgaataacatttcatagtgggtctaaaagttctaaacggttatggaagaatgtcatatcgagatgatgtattagacattggtgattcagagagagcagtggggcgggtgcttttgtgatcttcagggtcgcctcatatcaattgctggtactgtaccaagtttctcgagcgactcttgtccattatagtgggacattgtgcgttaggcggattccaatagcactaggcccaagagggaatgtcaggtgagtggttccattctataattgttgaatggggcgttcctggagagggcaaaacgcctctttcgcttgtggggctgttttcgagcgaattgttcatattcagggaaaaaatggaaatggaatcaaaataatgttcaaattttcaataatttgaatggtttcgaaattgagaagaatttggaaagcatacgaataacctggaaaaatgttgaatgacctggaaaaaacgtgaaggacttaagatggctgtattagattcttctctcgaccaaaaaggctcgttgagagggtctcaggacactagtggagcgtttgatgccgtacggcatcttccagactaaaatacaactttgtgtgggaaaacacaactttttgcggcgatttatcagtgaaaaggtgggctgttcagcggagggatgaggctgtactgccagcagcaactctgaatgttctgtgtctcattatttgagtgaatatgcccatcttggttactgttctgttgctacatgagcgagtatcttcacattccatactatttggcgaatcaggtaatagtaagggcggtgctattttgaggggttttagaactggaaaggtcttattataactattcttcttcttcttcttcttcttcttcttattattattattattattattattattattattgttattatataatgcaatggaccaattatggtactttttttcattcgcaatttttttctgcatacttacttgaactcgaaaaactccaacaaaagcggattaaaagactcaactatcatccccgattacttgcaaatcccttctgcaaccactcggaactaacaataaccatcgtggtgtagaagcatgaaggaagacaagagaagaacgaggaacgaacatggaacgaatttggagtgaacttggaacatggaactatcttggtaaaaacactagagtacacggaactaaccacacagttcacacaggtcatatagtacgataacggcggctgggactactgtagggaaggctggtgagccatcagagtggacgctagtgattagtggactgatatcaccgagacgtaaagttgatgagtggatgagagaagtagtaataacgagatgcgatccctcaacttcctacaattctgttcaatcgacttctatatgactttttcgtatacaattcaacaaaacaagtccattcttttccctgtcatttggttctctgtcgatagtaaaccgactaatcccctctaggggcactaatcaccaaggctgcaactttttgtcattagcgaccagaattaaacccctaccagttcactttagtacagtgcaatatgtactcgtactctagtgtcagtctatcaacacgtctttggagccactagttctgttgtggaggtctgtctacgtctcttcctacaattgttggttgagtcagacgttgacgaccctgaatcctccgagattcgtagctgacttgtacttgtatccatctactcgttgatccccccagaagatgtttcagcgaagccttggtaatgacacaacttcatccagcgagtaccgtacaccccatactgtagcatgcgggttcgcatgactgaaccacactacaaagtgatctcaacatgacgccatggactcaattggtacactgttcattgacaatctggttgttgatggtggctgaaattttttctctctacttgtactattttcagacggattgtgtcagtcaattgttgctctggtggagtacgaattgtcaaaccatgctaccaactttgcactcctcaatgttgctgatgttgacagtcgggttcacattcgtctgcggtcaattgcatcaacactctgagttatatcccgatatccccaacgtgagcacttgttggtttcaacaccagcgagggcattagaactagcaccatgtaaggggaggtgctgaataactgcggattctgccattcacggatgcaaagaagaactgaaaagggggactggcggctagatgaagactgtagggtggtttgatcatgaataggcaagttgcaaaaggcccagagtgtttgtatacaggcaacagtgcaagtagagaagggaaaggtttgattttggcaagaatctcatcaactctagcagtttgttcatagagacaaaccgacgcattatgaccttttgaatatccacctacagcgtggataatcgaatgttcgatcactccggcaccctagcaacttcgcgtctggaccatgatagcacctggaatcctaaacaagtgtgctcttacgcgctgctatggtcctgtattgtcgtaacatggtgggatattgtatgtgttattggtatcctgcctatagaaccatgatggactgggtatttctatctatcctcaccgaacctgaaacgttgtaccgtaataggcgttagatgtcggcccctggaatggtaagcggtatcagataagagctaggtgtgggtattatacgatcaagtgctcattgggtaacgcatagaatacacagtctcatttttcaacgtcctactacatgtccaagagggtctatggtccattcttagtcagggcggttcaacggacaagtacctgtagcactgaccaaccttgagaactgaaatcttggccagcagttgacgatcgagttgtaccaattgtgtccgatcgtattggcagctaattctcgtattaagtgctttttgattggtttatagacgtggtgttgtttggatcagtctacaagaagccgagacgagcactatctaagtgagatggttcagcagcagtggactgagctccagattcaacatggctgtcacatgactaggaatatccagggtaaatctcacgtgaatgaggagttctggactggatttggggtccctttcctccgttgagtggcagtttcttggaaatgatgagctcgtgtcgaatctctcgataggaccaggggcaactggagtgatcgactaatgcagagaggacttgatggaggtgaatcttcccttggaatggctctgtttgaggagactgcagagttaccaaaagaatattcagcggtagaatagtatttagaggtaaaagtgtttccagaactgttgtaggtctcttctgacacctttaagaagtttttgttgtactatacctgacccattgaacccacccagtacagagtcaggaacactcatctgagaagatgaaggacgagacagacgggactcgaaactctcaatattagttgtttttttttttttttttttttctgcatatacattcatttaattataactttgctgtgaaagaataacctttgaaatgaatgtacgcttacacgaatattactaattaaacacgtttagtgtcatggtccaacttggcacgtacctatttccagtaaaaaaatcataaaaaaacctggttcagtccgtgttgtatgttggtccacatagcttcgcgtgtttgttcgttcatcgggaaaacgccactccagtctccagttctctaatctcaatccttccattgccctcttcgtttgcattgcctttgagaacgtctccttgtggttcttcttcgtcattggtttggttctgcgtcccctgtggtgactacgcgccctgctacgctgttctctcggtggcctcggccgccttttacgcttgctactgtctctactctcgctattagtaggagagatatctggagttaactgttcagtatccaactatccacataagtttttcacctttcgatatgctttttttcggttgtcaaaactcgtttttcgtttcatagcttgaaacaggccagaaacacctctgacgtagtagaatgatggtgtgtgcaggccaagaacccttgaaagacgttaagggcatttagaaggatattagccgttgaattaatctctccgaacatctctacttgcccttcttccatatcatcaagttcaatagggttatctttttcttgtccagcttggacaaactcataccgaggcagaaacgagttgtagatctgtttccaagtatctgggtcgtatcaggagttcaccaaacagttctaatctctggtcagcgaagtttcacaatgctttttccgctgggcgacacttttttggagaaatgtagctgtcagaagtccatgtatgtctgtatgggagccaccattgatcaaaaaaaaaaaaccggaaattcatcttgaaactgggtgtttttggtgtcgatttttttttaaaagaaacctgttggggaatctgctggaaaaatgacaccgaatctcgctatattttttcagagcatacctagactcattgatgttggtgttgacatgtatctctccattctgtacaaccgatacagtcttatagaggaattgcaccacactacagtaaatgactatatcagcctctaagaatatgtggaaattttctggaagctcatcgacaagatcattgcttcaattttatatcatattgtttcttttggaatcccctggcgcccaattaacacatgcagcctatgatgtaaatacatgagcttagggattttagtgattccgatagaaaaggaaaggcgggtttaaaacagcggtgagcttaccaaatgtctttactgttggtctaattgccataaatattgtttatttcaaataattctgtccacttactaccccggggagtctccttcataccaccgttgagcagcctgaataggcaagtcgagggggtagaagacacggtccagacagtgaagatgaggccaagaaagtcgagaagtcaagttctgaaatgtaatagccgtttctcaagggttattcaactcttcctgttgattggagatttcaattctgtcttgttgcgttcattgtcagtacgattgaatgtaagaaacgtgccggatcgtattggcagagtatgaaagacatgcttatgacttttaccgtaaaaatggtgttgtttgaatgagttttcacaactctgagactgctactgacgcagattatcgaacggaaaactggcgtgggtgacaaaccactagttttcactgtgaggggcaattcactcggcggagcttggcaacctgatggtgttctcggtcaaacatccacgaagatgatcagactctcctgatgcgtctctggtaagggagaagagtccagttattggaacgccccgagctagtgatgaaagtactgtacagaaaagctctctttattcaacgctgcccccagtggttcaccttccgtgagattccagacccagagctctaacagtcgaggagcctagtggagatgtttgccagttggttctcagtacattgtgtgcattcgtatggtactggattgtactgaatttgaatgagctttggactgttagaccaatggtgagaaattctgatacaaaaaagacctccaaacctctctgagcttcacaatgctagttcagtatgtactgtacctgtagcacaactacctcaatccagtgcaatacctcaatccgagtccgcatcagaagacctaccatcaacgcttcgtcaatgtcttttttgctacagtaagagcagtatttgtggactatcatacaagtatgattgattagatacactgtagtcaatgtaataacttgcaactcactaggaataccatgttcctatagtacaactcactctagggacaccatgttcccattatacacacccttctgacaaccaaactggtctttctcctgtgaggaattggccaggtaaaaagttgtctattacaagaaccgtcaacagcatcaaccatttttgaatggccgtccttcactctctctccataacgtcttccgtggtgtcccttcctttgcaagtctcattattacagcagtcatcagcaaggtatatcttttcttgttaaaagaaaaaaaaaaaaaagaagaaaaaaaaaaaagaaacaaaaatatcttgcaatggcatttgtcaagaagacacccgaaaagaacatgttgcggctttccgtcaagctctggaagaaatgttccctcaactccccataaaggcaacatggacggctcgagaagatcagatcgctaatggtgtcgccaaccctgttggtgagaaaaacccgaggttggccctgaaaccatggctatgccttcgctggttggatcaaggaccgatgtgccactctcggtgtcgaggccttgaccatgactcattgctccaactttgggtccaaagatcccatcaagtcctcccattttgtcaagaccgtggatctgtccatcaagaacacgtggcacttgatgacgttacttcggccttcaaagtggatcaaggccatggtatccttcttctatgacgagagaatccccatggacgtcgataccccctgtggagttcttgttctggcccgatcttacgatattccgcttcagggctctctggcgatctaaaccatttatgcgacagatgtccccaaggtcgaggctcttaacatatggcgacgggtgcggcctggaagcgagactgcggcagtgtatctcatgaacatcatcaagggctcgggaagtcgtaagtacgcccaaacaatggccacactcaccaaggtccattgataaacccgacataggcgcccatatcggtttggcactgtggtatagagcattaacatcttaatgagtcccccatatccaaaactggtgaggatcgtgtcttctgatatagagatggcggtcaaaggtagactggttcggctaatcgtaaacggttgtggttgatttcgtgattcgtcaactccttcatcacgtggtcacatgattaggtacttcttgtcacgtgaacacatggttccgcgctccttcattacgtgttgtcatgtgggtacagcctttgtggatacgattccagctttccttcgccagaacgctgaactcgttcatggcttcgaagtcgtcgtctgcagccttctttgcagagatcaacttgggtggaagccggtacatcttgaggttagcctggagttattggatggtgggaatggctctgagatgggtactcgagagtcccagaagccacgcacggcatagagcgacttggccacgtctccgaaccaaggcgggtcagatgcggtgccggagtgagttgctgtgccggagataattgcagtgccagaatgagttgcagtgccggagtgtagtcgcggatcgccccacgatcaagtcgccgactccaatctcggatatccatctgttgacagtagtgtccagatgatagagccactgtagcagctcgatggtgcggtttcaggtcagacaatatcggacgacattgtgaagattgggagccgttagttaaggtcagcagaacccgcttgaggtcgcttcattcctctttaaccaagtcaggatcgtcggtgtcgggtcgcatcacccgttgtttcgggttccggcgaagagtgaataccggctcgaggccagctactcggtcacgtcgatgctgggaagtggaggtcattcggaaagcaaggcatgtagcggaaggctgacgtaattgaacacatgttgaacctgtgtctatcgggttgagtcgtcacagcatcatgtcattagataagtctacagtgaaacgagtggtactgtagtcctctcataatttatagggtttgatgtatatatatatatatgtataattatattttctgcatatactatatatactacagtatggttatgacttgatattaaacaattactataattaaccaataatacaaaaccacaaagtaaaagaggcccgttattatcaagtcgaaccgggacccagaaattacccgagaaaaatgagagaacgactgattaatttatattgaattactcaccagctcatcgcctcttcacccataaacttttgattatgcacttcattgcattatctcaatcttattagcgaaatttctgtacatacaatatataggatgaggaactacagtatccgaatccgacggatatttcgagacattgtttatgtagagcaaaatatgaactgacctcacctgtaatacaagttatctttacaggaaatttgagccatatcacccagaagttttagatcactgcctacagtaggtcctcctgtgtggactaaaagcccggtctcgtctatagcctcctatcgaggatcgacttcccagggactatccataccattggagagcttttggacggtgtttgtgaccgtcacagcttcctaaccatgagttcatttgctgaaggctccacgactcaagtcccactgcatcgttctcgctcagaagtgtatctctcagtgatgagatcttctgcaacgccgagactggctacttctgacagggtaaaaacaggctgttagggcctttcatactggctcgatcaatttggaatgtcggaggtctgttagtggtaaaaaaacgtggcgataactgcacaaacgccctgcgaggaggaaaaagtgactcggtattgtcgaggaatgaacggaaaatggtgtcaatggactgtttgggaagaagctgtctgtgaagaaactgtctgttgcttgtggagaggttgatgttgagttgccctggaggagttgaatcattttttttgcggtggtggttgtggttggggcatgtgcatgttgtaaaaaaaaaaaaaaaaaaaaaaaaaagaaaggaaaaaagaaaaaaggaaaaacttcgtcacccaactctcaatctgggaacagatatatttctgacgaagtacccgtaaatgattaaaagacgtcattactcggtcaaatggctttcatcaataccaggcagatatgggactccatcgggttggcattggcaacagatgaacatcgaaccaaaaataaacgacggtggagtaatgaaaatatgaagacagatggagaacacaaccacagaaggtgatacgaaaatctcaataacgacagtcgttactcactacacatctcctttgtcactcctgactggtctcgcattcacctcgttgaatgtgatactggtctgatcaaaacaaaccgactcgcggttgaactgttctcttttctcttcttctgtcttctcttttccccttccctcctccctccaccacctcattaaccaaattatcatgacaaccgcttctacaaccattacctacgaatgccccatctgccagaagagctgtgccccagacacttttcgagaccacgttaaacagtgtgtctacacttatgtggatgatgtcttggacaaataagagacatccattcggctaataatggtataattgatgagatattgtaaaaaactgaagttagtggcttggtttgagcagtggtcctctgttggaacactttgatcttgtcttgtagagcccatagtctgggaacaccatagatcgaggtcaattacccagtcgaggttgtagattctgtcgagtgtctgagatcaggaccattgatcttagtggagtgatcttagtggagccctttaagtatgacccagtagcagcggctaattatcgtgtagacctctaagagagactgtaatgaagatcaagagccgggcgtaagtgtttcagaattatgggcagaaaattgtttcaagtgatcaagtgagccttccgctttggctcgctcgggctccgataattgcggatgtggtccctaatgtactctgttctccaagcaaacctcctcaggcagaagcacggaaactgtctcccttgcgagtctggcggaagctaagatgttgaccatatcgccacggttcatatcagttgctcgtataccaactgaaaaccacattttcccctcggttccattggactctggacgctgtgtgggtcaagtgctgtatgctactacgaagaaggagacggcccatggatcactcgaatcacaagacaacttgagtcagtctaacagcttcacattcgccctcctgctcacattcatatttccagtaggctgttagctccgaaccagtgaccatgaaaagccgtagggtcaatctcgtgatcatgatctagcagttcgatgttggcatgttccgatattggcggcctagagcaatctaggatggatctgttcaacttgttggaatcatgtatcaaaattactgagaccaattgacccgggtcccaatcaaccccatctccatttgattctctacaggctcgtatttccccaactagcccagagttgtttcactatgaactggatacctagttccaatctctcacaactagtggtccactattcaacaacttgccagatcccgttcctctttttagcgcaccgccctggggtctagcagttggtctgcgttcgaggttccccttggtgcaagcacattcacaattcttgcaacttcggacgatctttgactcttcaatcaccgcaactattccaaaagcaaaagagccttctgcctcctctcatcgacttccccatagtctcccctctaagtctctctagccctgtgtctcatattcacttctagacgcttcacatccagaaattccacctctagacatctacatccagacattaccccgacctgacaggtttttccggacaactggtgagtatttatagcccagccaaggactttcctcacctcatcaaacccacaatgaccaactttccaatcaccaccgttcaaatgaccgctgttccaacgacaaccgtaccaaccaccaccttcccaatggcaatcactgtctacgactttgacaacgtgtttgtgaagtcgtacccaaacgtccccattcccagaacccagcccggaagtccgaagtagagtgtctcaactacctgcaaaagttctgcccggctctgcagttcattttttgggtacggaatcactccttacgtcaaaagcgaacccgtctacccgttcgaggaagtcatctacccctcaatctctccaatgttccgaaactgcgtgggcttggacctcaagcagacccacacccaatccccgaatggagttcaattccagccgagttgttgaaattagccccagtccagtggcgaacttccactccagccgccttctagacaattcccaccgtttcgaacaccttatcaccaaccgacgactcgacaagatcgaaaaggctctcgagaaggtcaaggcccatctggtcaagcccaaggtccgcgaggtggtcgtcatggccaatctggaactgtcctatagagaattccaactaattctgaatagatcctaggtaattcccgataggatggttccggcaaatgtctggccaattcctcacatggtcattagaggaaccaggttggtcgaagacgagatgtccatcctgtagatgtgtatccgctgatttacaatctcttgtcgtaaatgtgcaaacacacaccctggtttgtggtgctatcggaacgttgtgtcgctagaagtgagtcgtaagttgttacatcaactactgtatatctaatcatcatacttatgatcttcattatatgtgttatggcaatattttattgtatgcagaaaaaaaaattatgttaatacctaacaagtggtcatttatacaaagtccagctcgagaagtactgtagttgtacttccatgtaaaatgatattatgtatactttgcttccaaataatgtctttttttttttcatttttttttatttttcactctttttgatagtattaatcccattttctgtatattaactgcctcaccttcagtaacttttttcttgttttttttttttttattttaacaataataaaatcaaaaccatgtcatgagaccaacacatctcaacaaaagccgtcataaaagtccatcaaaaatcataatcaaattgccccaaattttccatctctacatctccccattgccccatttcccaggctctcggccacccaaaagacagtcgcattttcgtattattcacccttttctttttcttttttattcccaaccctaactcaggctaaattaatctccactgttaataagcaatcatctgttatctcgcattaaactcaatctccagtggcacccaacacaacaacatacctccccagcatctcccacaaaacacgccacaatgtccctccaacgagcgctgcagtatctgtgggacgcagaacctcacaacacggaccacgtcacgcctctattctgtctgggccaggtttacgacgcagacaccagcctgaaggaggtgaatgacgacacagaagaagacggcatagtagtgccgctggacacgtcaaatgatacgtcgtggcctccggactttctggcggacgtgcagtcgcgaatatggctgtcgtaccgaaccggtttcccactgattccgaaatccgacggctccggaaccatccacttgggcaaactcaagaacatgatacgtggaggaggattcgatccgcgaggctacacatcggacgtcggatggggctgcatgatccgcacgtcacagagcctcctcgcaaacgcactgctattcagacacctgggccgaggctggaggtggaacaagggcgacgactttgtgtatctcagtgaggggaatacagaatcgaggggtggcgaaagtaggaatggcggtgctaacaaagagcaagaaactgctgtatcagaggaaaccgctgtctcagaggaaacaataatatcctggtttctggactccccagactctccgttctcaatccacaagtttgtacgtcacggcgaaaaagcatgctccacgccagctggcgactggttcggaccctcggccgcgggaagcagcatttatgccctatgcaacgagtttccggactcgggactcaaggtatactacaatggcaacggaggaggagacgtttacgaggatgagctgttggagacggggttccctcttctcgtgctctgtggactacgactgggtatagataacgtcaaccccatctactgggactctcttcgtcagatgctgtcacttcctcagtctgttggcattgcaggcggccgccccttcacttcgcattacttcttcggcttccagggcgaacaattgttttacctcgacccgcatcagcctaagccggccgtcaaaactacggacaaagataccacctcttttcattccagcagaatctggaaactgcatctgaaagagatggatcccagcatgttggtgggtttttacattacgagtgaggccgactgggagacgttcaaggggtctctgacggcttcaaaggagaaaaccagctcccagattgtccacattcatccctctcggcataacattccgtcctttgatgaagaggacgagtatgtgtcgattggaggggcttctgatgacgactttgtggacgtgaccaaacgggcacgcaaggtggcagccatgacaggaaacacaggcagcgggcggtcttctccatcgattctcgacagccacctcgtcactgagacaagggatattatcgagtccgttcctccccgaaaacgggtggacaacgacctcacttctgccccagtggacgttcccaaacctgttcagaagagatcgcaatctcatggagactgggagaaggtagaagagcctgaggaggagatggtggaagttgagagcatgaagggtatgcaggacaacggctgctcggccgagtacggttcgctggtagatagagatgcggaagctgatgacagcactcttagtacagaaaccacggatcgggattgggtagtgtagttggcagactcgaggcaccgaatatgtcatctatatacttgatcgaagttgtaaaatcacaccatggaatcgtgctccttaggacggtgtcatcatactggacagtcgtatggccttgtgttgtattattcacatgcctgccgttggacttgccgtttctgtcctgcttataatgataataaaatacatatgatacataactgtcaccagaagacgtgcaaacggcagtccactaacgacaccggggttgattaatactcgacttactcctcctttcgaacaccagcaacaaccgaaaactggcctcctccaccagccatcttgacatcgatgggcttgatggcggtgttcatgatctttcggggggtctcgacatcgtcctcctcggcatggcctgtctggaaggacgaggagaagccccaagtccacacacggccgtcaacatcgatgatcagggagtggtgagcaccgcaggcaatgaagcgcatcttgggcagtttctcgtcgtcgtcctctccgccgagagaaagaggagaaggaacgggcaggaatcgagggttgcccttgtcgtctcgaacggtgccctcgggaagatccttggtggtgaagccaatctggtggtagtcgtatcgtccaaaggagtagacggttccgtccttggacagagccaaagagtggtgttctcctccagtgacggccacaatgtcctttccatcaagagcatcgacgtaggtgggtccgtcgacggcagcgttgtcgctctggcccagaataccgcactggccgtactggttgagaccccaggcaagcacctttccgtcggtatcaattgcaaacgaatggaactcgccggcgcctacgtacacaatgttcttgagacctagctctcgaggagaaagggtggatcggttagacttccatcccagacggaagttttccgagtctccccaggtgtgcacggttccccactgggtcagggcgagcacgtggtctcggccagcagcaatggcggcaatgttagacagctcctcgatcttgacgggccggttctggaccttgaccttgtcgctgaaacccatggttccctgggagtttcggaacgagccccaggcccacacgtctccctcagcagtgagggccagagacagggagtcggaagcctcaatcttgacgaaccgctggtcggtgtcgaccagggcgggaattgactcggcagggttgagcttggggtcatcctcgtcgtcggactcgtctgcgtccatgtccttgagcacctcatggcccgaggtgtctcgtcccagggctcccagatcgttgcctccccacgaccacactcgtccctgggagtccagcaccagtccatgctggcctccgacggcaatgtccacaatctccttggacaggtagggcgatagacggggtcgcttgacagtggaggccttttcgggacccagacccagctcgcacatgtctccggttccgaatgcaaacacctcgcaatccaccttgttgatggagggaaggggcagcagcgtcgggctgtgtttatgttttcgctggatggccgacagtcgcagccttgagggcgccttggccgcgggaatgggcttctcctccttgaccgtcttcttctccagctcctgcttggccgccgccgccttgactccgttgaccttggcggtcttggcgctctgcttcttggacaccgccttggtggtcgcgggctttttcgtcactttggttcgggttaatcgcaccattgtctgtctcggttgtattgtagatgtgcaagtgaaggtgtggaaataaaaatatgcagcaagggcgaaatctgcagtagcatttacttagggtttcgatacaggagaggggtgttaggcgggttggaggcgcgaatgcgaccaatggcgagcgaatatctgcgaccaggcgaaacagacgcatttccaacggccagattagtcatatggcggttttgcggcccgacaacgtcacgtgatccccccgtacgacacgtgtctggagctgattttgcgaacccaaaagttttctggaatgggcattttccaaacattccatgcacgtactgtatgcggattcatggggtgtatatacaagtagtggcacttgggtgttgagtatctttcaactaaattgctaagtattgtacaagtaagtgtgaagacgagtttggtgaagacgagtttggttattcacatgatcatgagtattggatacgagagatttcaggttatagactacgttgacggactgtcatgaacgaacctccttcactaaatcaactacaagatagcacctactaccaatacctgtgatagccatcaaagactcgatttcagactcccatctcttgttcttgtgattgcggagcggacaagacccagtcagttggacaacttgtcatgagactaggcaatgtcctctgttcgtcttgtgatttatacgtcaattgaaccagcgatcagttgatctttctgttccagtttcttgacaagttgtcacttccatgttcaaacccaccggcagtgtttgagaatgtccgatacaactcgccacacatgtagtccataaccgtacattctgcttaacagattgcggctgtagcaaaagtgaaaacgtgagtccaatctatgatccatgccaccagcggtcactgttctgatcagtatgggtctgggggctcacgtgtctccgatcaactgcgggagcatccttcaggattcacgtggcccgactcggagctgtctggttgcgaggagtagcgcggtggtgtttccgtctcaggtgctcatttattgacttggactgcggactggttctcgagcaacgatccccttgccagcatcatggtcttccgcagggcatttatcgttagggtgtcttgaggggtattaatgatcgactcaagggttgtcaaggtcgactccaggcctcttggaccaaaggaggtatctattgagcagatctagacatctctagagcagatctagacatctctagagcagatctagacatctctagagcagatcgagtctcttgagaagttcgagatctcctatgggccaaatgagttctccggtgagccaaatgagacctcccacagcagataacgcttgcgtcagcctaaaacagagtcaccagtagttgtccaccatttatcttcatctgtttcaccctcgactcggttgattgtcactcatagcactcccgtattgaatctccagtacatacagtacttacggtagattcaattgtatccaggtccgcaaggattttcccttccggagccctttgctatgggacagatgatttctcgttgaaccgccattgtcagcactctgtgaggaagggtctgggtgtatccaacataaaggcttgagtcattgttcgacactcaatgcgtgcaccgcagtttccgtcgctccattgatcgaattcgaacgttcaaaccccctgagaattggttgtcagattgttcagaatgagacaacctgggccatcaggaattggcatcaccaggtgacacaagaggtggatgcccatgaccgaggtggatgctcatgaccgaggtggatgctcatgaccgaggtggatgctccagcacgcacgtctgagtcaagactccagttggacctgcgagaacccccatcttcacacccccaagcaatcaccatgatcacatgaccatttgagcagagaaaccattgccaaactccgtgataagacgaaccgaatctcttcaaacaaatcaaatcttttaaatccaacccaccgcactccagccctcccatcacgtgtgcggctgatgtgaaaaaaggttcgtcccatcgggaaatcacgtgcgacatatcttgtcttcaatatttgacagatggtagataaggtggaccatctacaagtaatgtagtctccgtcaagtctcagaaaaagacaccccaacacccaaagtcgacggaaacaactcgcccatatatacaagtccaccacaaacacaacccctgccctccccgcccacgtgatgcagttagattactgttcacagcgatcgggttagggtaaccacattgttaccgagacgcctctattgcttccatatatgggaacagggtagttggttgtacgacaagcagaaacaagtgttgacattgcgatcggaaacgaccctcccccattttcaatcacgtgacaccgtggcacgcgctcttatttcccggtcacgttatccccccccactcccccgcgtcccttcgcttgatatatactgtatatgcctccagcagttgtaaataattcccatagttcaggctgtcgtaactttttgctgatcacaacagaaaagcctcagctcagcctcagataacgacggggcggcttggaagtgagcggttggattactaatcaagtgatgggggaggaggcaaggatttttgctcacgtgagtggatccccataataaataaataaaacgtctcccgtctatatggcataatctccagacacggttatgcatctttactaagctgaagctgtaactcagtgcatgcagccacctacttcaagtatcgtgttgagcaacccccacaccacttgttatcaccgccacaatgtcgctattattcaacgagcaaaacacacacaaggacgacacggtccccgccaacgagaaggagatgctgagcaagctggtggctctccgggaccagttgaccgcgctcaagctcgaccgacagacctatctcaagcaggaagatatttctcgaatctacaaccaggtggtggaggaggtttctctgctgaaccagattcggtcggatcccagcttggaggacgagtacaaccgggtggatgtcgtattggacgacgttttccaactgctttcgctgtcgtttctgaccattggacacaacaagagtgcggccgcgacgtacgcctctctttcgacagttcgacgacttctgagtcatctcaaggagtcgcaaatttacacgggcaacgactacgagcctgttcgggcgcggctagacgagatccaggcgattctcaagcagcaaagtgaagagaacccggaggtgatcgctctgattgaacgagagcttaaggtgtgcatggagggcctcaaggaggtggaggaggcctacaaccacgtgattccagaggtcggcgtgctgctgcaaaaggtttatacaatccgacgggagatcatgagcgtggcctctacgcctgacgccaaggacggaaagcgatctgtggccaccgagctgcagccgcttctcaagcaactacagaatattgagaagacgcatctgacgggcgagaaaaacgagttcatcacctcgtcgggagagaagcttgtcgacaagtctgctggtttgttggcgggccagattgacgactgtttcgagctcatcaaggactttgaggccgagacgaatcgagtcgatccttctcttctgcctgtctactcggagctgctgcacctcaagaccactcttgagggtcttaccatcacccacagatggacaatgcgagaaaccgatctctacggctaccagaagaagctgcaggcgatcgatgagcgacgggtgggcggtttatttgtgcccgagaaggacaaggactgcacaacctgcgatttggctgactcggtgaacaacctgtctgttgacgataaggacaagaacgataagaaggactcattggataaggagggatcgcccactaagctggccgggcagtcgattctgctttacctgctgcgacgatgctacgccctcatctacaagctgctagagtcgtcggagcctatttccgaggctctgacgccactacacaaccagctcaagaccatgcggcggttcctgctcgacataaagcgtttgggcggaatttcttcggtccgagaactttatccataccagctcaagctgcgatccattgataaccagcgagtggatggcaagttcatgcagggaaactccattcccgagggtcagggaatggtcaatgctttgttagcggagtgttttgatatctgtcatgagttgcaggttgattacgagaatgaagaggaggacgacaacaatgaagatgaagatgatgaagacgagaccaagtagtaatacagtgatatctaataatgaataatgcttgagcaatcccaagtcgatacatggcatagacgcgaataacagacaatgctggtgtctatatctggtaaaatgacagaaatacaaatggactttacgctagcaaatgatggggaaattgtagcggtggttgtatctgtttctgccattacgtctaccgtaggtgtctgcacatgttgactcagagagtaaatgcttgtgacggtctattcaacaatcttctatacagtcatatccaacattatggactcagcctaacagttgaacaaacatctcttgatgaatattgaaggtttcaaagtcttcaaattactacaggactggctcagtctaatggggagcctctccgttgcttcgcacgctatctttttctactttttgcctctttttttttggcccactttttcgccagttccgacctcgaatccacatctccgcccttggcaaaacacacggtcccttggcccagttggttaaggcgtcgtgctaataagaatggcagctttgcaacgcgaagatcagcagttcgatcctgctagggaccatgtcacgagtgtggcggatgttttttttgttttgtttttttttcatcaagacagagatatgagtacagtatgtactgtaactatacaagtacagtacatactgtgcacacctgcggtggtcaagtgtatggttgcagaaccgttgagttgatatgtaaaagttgtgtctttataagggtatgaacgtgtctatcaaggactattccgtcttttaatgatggtttctgcgtgtttgaatggtccactggtgactcggatcacggcggacatggaagcaatgaaaccaaccgatccaccgacgagaacggctttgtgaagtctgcagaagatgtcacaagggctttttcattggttacatctcaatttgaatcaaaagtagctgctcacaatgccacagaggagtctccggaaacctttgtttaactccgtttaactccgtttaactccggatggtcattgagcgaattttggggggattttgacacgggaattgtggaataacaatatgagggtgtataaattgtcattttgaacagttcagttgccgttatgtatgtatttgtgtcaggattcgactgttgtttcaggcaggtactatgtgggtgtagacttctttgaactcatccagatccgattcaatcagaaaccctctagttggatcaagctatttgacagtctcaaactgtcttcaaataacctgatctgtgaacgcttcaatactcctaaatctttcatccacgggcagcattgagatccgaacaaagtactcttcaacacatgcaacacttggcagaagaagaagaaagaagttctagtttgttagaattggtatttcaaacaattatccacacaaaaagttccctcccgacgtggttctaatggaaatccgtctgtttactatctatctatagaaaacagacactcaactataacccaactgatatccataaatactcaactaacttacttggaacaagcctccatattccaccaatatatcggcatcgtctgtgggaatacaatctacaggaatgtattgctcatctaccataaacaaaccaaatcacctcctcctggaccacaccacatatatctccgagaatatcatgtctaatcgactacatactagtgtgctcttctacttgactatccaaactccaatttatgctactgtactccccacattgacactatctcaccgatagcatgtctttggcgcgcgcgttctttatctctgactcactcttatcggctattgacctgcgttgggtcgacgtcagtaggcggatatggtgacatgttgacataaacaagacaaaaccagacagaacaagacaaaacaagacgtcgaacatgccaatgagtcatttcggacccattcgacacgcaagcgtattttcggccttcaaacacgcacagttccccggatcggtgtgaatggacgcaggtgtactggcagcatcttggaaccagtattgttgtagtacactagcggtgcgagtacaactacaactacaactacaatagcggctctctgctcgcatcccctcaaccgttaagaacccaaaaccagcctcgtcatgcttgtctacactcaatctccatgactcaccttattgaactgtacctgataacaaccagtcacgtcaacacacctcgcaccttacacctcccgtctactggccgaatcgcacctgaaacgcacccagtggctggacattctccttctgcagatcacgtgacgctgtgttttgtctgcgcccggaacgttcgggattttcgaggcttggcgttgaaattttggtgcttaaaatgggcgtgggttgcagtccaacacccgctctaaaaggggcgtttgtggcgctcaaggtcgcgggaaaagacgaaaaatcggacgaccgttgccgtagcgacctcctggcgccgccaccgccaccgaaaaaagccgcaccgggccaatcactggcggtggacgggatttgtgttgggtagcgcatagggtttttcaccgacccgttttagctttgtcaattttcacccccccaaaaagcctattttttttggcggcccaccatttagtcacactgcaagataaaaagagtcttctttgatccacagagcaacaagagcgaaacgccgacaacatgtgtggaattttcgccgcctacaaactgcccgacgtggccgagtacaagacacatgcgctgcagctgtccaagcgaatccgacaccggggccccgactggtcgggaaactgctccaagaacaacaccatcatttgccacgagcgactggccattgtgggtctggacaccggagcccagcccatcacctcgcctgacgagtcgattgttctgggagtgaacggagagatctacaaccaccgaatcctgcgaaaggagttccccgactacaagttcaagacccactcggactgtgagcccatcattcctctgtacgagaagtacggcatcgacgcccccaagaagctcgacggaatgtttgcctttgttctgtacgactccaacaaggaccgaattatcgccgcccgagaccccattggaatcaccaccctgtacatgggccgatcttacaagaacccccagactgtgtggtttgccagcgagctcaagtgtctggtggacgactgtgacgagatcaaggccttcccccccggccacgtctacgactccgacaccgacaagatcacccgatactttgagccctcctggtgggacggatccaagatccccaccaagcgagttgactacaaggagctccgagaggctctggaggctgctgttcgaaagcgactcatgtccgaggttccctacggtgttctgctttccggcggtctcgattcttctctgattgcctccatcgctgcccgagagacccgacgagctgctcccgagaagaccgtcaaccaggatcttgccggtgtcgacgagcagggccacctgaccaactcttccggctcgcgactgcactccttctccgtcggtctgcccggcgctcccgatctgcttgccgcccagaagtgtgccgagttcattggcaccatccatcacgagtacaccttcactgtccaggagggtctggacgctcttcgagacgtcatctatcacctggagacctttgacgtgaccaccatccgagcctccacccccatgtacctgctttctcgaaagatcaaggccggaggagtcaagatggttctgtccggtgagggatccgatgaggtctttggcggctacttgtactttggcgctgctccctctcccgaggccttccacaccgagtgtgtgcagcgagtcaagaacctgcactacgccgactgtctgcgagccaacaagtccaccatggcctggggactggaggcccgagtgcccttcctggacaagcagttcctggaggttgccatgaacattgatcctaaggacaagatcatcgacaaggaccacattgagaagtactccatccgaaaggcctttgatacctccgacgagcccggcgctgagccctacctgcccgacgagattctgtggcgacagaaggagcagttttccgacggagttggctactcgtggatcgacggtctcaaggatgccgccgagaacaccatcaccgacgagcagctcaagaaccccaagcctcactggggtgctgacgttcccaagaccaaggaggcctactggtaccgatgcatgttcgacgagctgttcccccagcccgccgccgccaccaccgtcatgcgatggatccccaaggccgactggggatgtgccgaggatccttccggacgatacgtcaagtctcactctgctcataagcagtagagagctgagatagcgagcaagtgagcatggcgaacgagcaagcatgcgaacgagcaaacgataatgtaattaaaagtatttacagtgaatgactgagaaacctgagaagttgtttggtggctgtgggcgtagtgctaggagagcgagatgttacgagcgagacgattcaagcgatcaatgacacatctacgagtttctacgacggtctcttgtatgtacgtggctattggatgctatagagaatcggcaatgacagttttgagaagccatcctcaaaatgctgactccgatccatactcactgctggaacatgcaaagatcgatctgtaggtggaactagaccgtctaactggtggtcgaaacaaatctacataaggattgattgaacaacgaaaagttgacacagtccatgaattcgaagataagtagaggacggcgtaatacaagtacagcacatactcgtacttatgttctgcttgtctgattgttaaatgttctcatggtatcagacccaggaagatagatggagctatccaggatggagaggatagtgacgaagcattatgactggactcactagttgttacgtaaaaattaatcatgataaatgttctacaaacaaaattttgaatcagctgttcctatagtgtgccctcgtgtcgaccacattaatggggagtaaagtcttcagagcatgccatatctgggttgtagacagtatacaaaagtccatttttacaatctgaagcggtataggggaaggtcgtcggtttagtctcacgtgattcctcttgcgtcaaaaattcatctccaatcacgtgcccaaaattcattttggaagcctttcctattgaatgaagtgtgtcgactgacttttggacgtggggtactattgggacagctgtgtacgaatattttactcaataagacaaaaaaaaagggggaaacaaataatacaatccttatcaacctttatcagctctctctatatctctagacttgctgtcattccttatactccccatccggtgaccgcgaatcattagtccggccgtcatctctgaaagtactaaaggagtgtctgttacgagaattttccagctaaaagtactacctgaaaccagtcaagtcatgtccaatcaacacaattacatctgcacatactgtcacgcctcgtttgctaccacaggcgttttttgaccacgctaaagactagactgtgtaaggaaagagatggaataccagtgaggggaggagtttggttagaagttatttgtggaatacctgtgaaaatcatcagtttcggtgatcatcgactttatggaactttgactgaacccttgatcctcgacttggtgactccattgtgcaagatgtaatcatttggtatatcagacgcaacaactggcagaatttggtcagcaaagttgttgactattgaatgttcaagacacatttgtagatacaatcaccggactctgtatgagtcgaaagctgcttttaatacttcttccaggagctgaggagatactcgtagacgtccttctgaccccagtatgtagtatgtactgttcctgcgagaaaaaaaaaaagtctttacagggatttagagagttgtatgactactaaatgtcctggtgcctcttgctggcttcaacaatacaactgagatcactgtccacctgccccgtagccatctacttgtagtactctgagctcggagagacctaaaaaaaccgatgtcagagttccaaaaacagtgaaaagacctaagaggcgataataaatgtcacctcgtatctatttacctgatttccaaaaatcgcggcacttttcaataattctagaatctataaaacctgctatttttggtgtcaaaagcggtcccttggcccagttggttaaggcgtcgtgctaataagaaattagcctctttgcaacgcgaagatcagcagttcgatcctgctagggaccattctttttgggaaatgctgttgatattttggaggcttggtggtgatggaggagatgcaatatctttttgagacgttttgagacttgattgtaacagccacttgtccgtttgtgaccaactggtattctccttatcacttttttgtctgtatattagctacaagtaggaacatactcccacaatcaggcgtgaataacccataaatacacggaaaaaaacgatgcattggacaaacgagatccaagaagattagtcagactagttttcaagtggtaaaacttccaaaaatggtaatttacccacacaatgacatgttttctgatccattctaacaccaactaattacttgagatattcaaagcctaactaaagtaattacttaagtctaatctcaccctaaagtatcggttgatgggtttaaaggcaggatgataaacagcgtaaaaagatgacaaaactcggccgctgctcgactgcgaaaaagattacagcacccaggattctcgtatggtctcccactacaatactaactgggctctctggtgcttgactatggctgatcgaacgggaagccgtattttcaccaggatatggccgtaaccaacactccgcaacggagaattgaactccggtcccccgcgtgctgaacacaagttctgacaggcggaaattctagccactaaactattgcggattgtgaaaaaaatggaattttgtgttagtcactcaaattactgattactaatcaaacccgtaaaggtataggggaaaagacatttacgagctaagagcgagggttttttgtattttgttgagcctgtagaagatatttcagttcatttatgaagatattattaagtagaatgatttttgaggtgtttttggagtggataataactatggagagtgtacaggagcacacaagtatatactgcctcgggaagaatgtatgaagaccctgaactgaagctatgaaagagttgatagttgtgctacaagtactgacttatttcattttctttctctctctctctctctctacaatattccgaatgaacgatcatatattactgcccggacggtaaaatgtccggacggtctagaaactaaagaatagaactgcacttctcgcagttgagatactaggaatggcataattaaaacggacacgatggtgacaacgtcgagcgtggagaaaaactcaacctgcttactgcagggtcgccgcaatggtgaacttgataggatccggacaggcatagcctccgttgaagacgtagaccacctgtcctccgtgaagagggtctgtcttggagtcgcaggagtaaaactggttggttccgtacgaagaaagctccttgacagtctgatctccgttgtaagcccagcctccgctgttgccctcaagaggaggggcagggccgtctttcacgtccagctttcctgtctccacgttggcaaagagttgtcgaggtcccagtccctcagaaatgacgttggccagggcgtttccaacatcctctaccttgaagtaggagtagccctgctccagtccgtagaccacatcgttaccacggacttggagaggcttcatgccagaagctccctggccgggcaagatggcgtggagagagtaggtagggtgttcagttcgctcctggttggcgacgggagcagccaacgcagcagtggcggcggtaataagggcgacggtgttggagagcattgttgttgttaatgtggatgttgtagttgatacagaactatgagaaacctaggggcacttatatagcacttgcggagacttctcaaaatagaacagagtcaagtggtcaggaggtctgacaatcttctcgaaatagatcctaccgagtgtccatacgtacacaccctacagacccagatagtccagaaacgccgtttgcagttgagtttcggttatatttagcaggcataattcatgcatgtgggatgagctgttgggggaacattgtcgattgatttagttgagctgtagctgagattattgttggaatcagattttaatcaccctttaatccgagtaatcaagtcctttttcccatatctcctccaaaaccacctcagacacgagtctcaaatcccacatccactgtcaagaaacttagttataaatagcggcgtcttgtacagtactgtacgtactgtgatgccagccaaaatatggggtgtaagacatgtgtcatgagatttgtccaaggtgatatggtgttaattacagctccttgtgtcaatttcaactctctgtattaattacagctcttcagctcttgtgttccagttcacacttgctatccaccagacgtcatgaatgtgaagacgtcagtagaatgtcggtcagggatataacatcctaaaacttgtacgagtacgtggactaaattgcaagtagcaattgatgattcagagttattgcttcctcttttagtacagtaccgtattgtgcaaaagattcccgttcgttgaactagctacatcgtgccttggacatgatcgacgctcataagtgagatacagtctcgagaaacagttctacaacataccaagtattgtgctacacatcatagtccgtcaaaaccagttacctctataaccgtcatcaatcatttcattcatgtactaattaaagatacaaagaagcacagaaaataatgtctcgcttgattcgctcctgggcagtctccatcttgtcctgaagagtagcgtctccaataattcgggcggcattccgcacctctcgacacacctcatccagccgagaaatgacccgcacaatgattccctcctggacactggtaagttcggaaatggcctcaaaagtcatgccccgagcccactcgtagacaacctcaatgagtccgaagcgaccgcgttccaaaaactgctgctcatcagacgtcataatcacctgtcggtgctccagcacgtctgtcacgtggcccaccagctgcttgattcgttctcgacccttgtctagacgaggagtcactgtgatgggctcctccacatccttggatccttcgtaaacaaaggcagacaacaaggcgacaatctcttcgggctcgtaatcgcccaaaaagttgtcgagaacaagctcggaaatgaacagctcaaaaccagagttgatttcacatgccactcggcccttgagaagcacaatgttcttgtcgtcaacgtagttgaggtccttgagcacctggactcgctgctcgtagtcaggaagcagctccaggttctggtcactcagagtctgtcgcagatcggaaatcttcttgcggatctcgtactcctcgtactcctgcttgaacgatttgaggaagttggcgggcaggtttttgacgcaggggatttgcgagaactcaatctctagatgaatcttctcctggcacttttgctgcaactccagttccttcagccggtcccaagaacactcggccacacctccagaccgtcggcagatcttgttgatgttctggaacgcatcgtcgacagcctgcttgtcgtaccgagcaacatcacgcacgttgttaatgatgtacttggtaataaacaccagatcagggatcttgacagcatacatctccaactttccagacgaggggatcagaggctgcaaaatgagtcgacagtaaccaggctgctgggggaaaagaggaagagtagtggaagagccagcacaggggaaggcgaggattgaagcagactcgccaatcacaggacgagagatgaatccgattcgacgactggacccatcggcaagatcgaaaataacgactctaccaaccttgaaaatatcccgcatgttggcaatcttgggaccctgcgtcatgatgtacttttgacactcccgagcagcgagaccgattcgcaacacatctgccatatacggatcacagtcgggataaggcaccttttcaagcttggacaagagcgtctcattggacttgaccgaggcttcgtgctcgggaagaagcagctggttagcgttctcggagaaagaccgcttgatcatctcctcgaccttcaaagcctcgattcgcagcaagttcagaatcatgttgtatgtaagtcggaactgcgacttgagacgtgtaggctggcccaacatcatctccttgagttggtccagaggagcaacctcgccgggaaccatgataatgacggttccagtcttatcgagacctcgtcgaccagcacgaccagccatctgagtgtactctccaggaagaagtgttcggaaggtggttccgtcgtgctttcgagtgccggcaaacacaacagttcgagtgggcaggttaagacccatggcaaacgtctccgtcgcaaacagaactcgaaccagcgatcgagcaaataaaatctcaacgacctccttcacaatgggaagaaggccagcatgatgcacagcaatacctcgcgacaaatactcccgcatctgcagaatttgaggcagatttctgtcgtcctgcgagagccgagtcacagccttgtcaaagaacatgtgaatctcagacttttccttctggttgcaaaagtccaggccctgaagatacccagcaaactgctcgcacatttttcgagagaagacgaaaacacacatgggatggagattgagtgtatgcagcttgttgaccatttggacaaagtcggacttggaaggcatagtcgccgacttttgttgtttgggggtgatctgactgcttcctcctcgcgctcctccacggccacctcggcctccccgcgcattgtttcctcctcggcctgcagctcctcctcggcctgcggctcctcctcttccggctcctcctgctgcaccacctcgacctgctgcagcagtgttgctgttgccgctcataatctccttggccttgttgtatcctccaatcaaaaactgcttcttctcgtccacgacctcaatcatctggttcttgcaccacaaataattgaccagaggaaccggtcgcttgggagtgctgatcacgtaaatatccttttgcttggttcgaccgacccagttggcaaactcgaacgtgttggggacagtggcagacagcagaatgaacttgacgtgctcaggaagcatgataatgacctcttcccacacaactcctcgatctgcgtcgttgacgtaatgaacctcatcgaaaatgacgaattcgacatctcgaatgagatcggcacctctgtagagcatggatcgcagaatctccgtcgtcataatcaaagaagaagcctcggggttgatctggacatctccggtcagaataccaacgtcgtcaaaggtgtgcttgaagtctcggaacttttggttggaaagagccttgatgggagacgtatagatggccttggtcatgttgcgctgagccatggcaatggcgtactcggcgataacggtcttaccggcagacgtatgggcagccacgaacacagagtcgccctgctcgagatggtaaaccgcctccttctggaacgtatcgagctcaaaggggaactctcgagccatttgaggaacgagttcatggaagttggtgatctccttgttcacattgaccacatgggcccagtccttggtcttttgagtggtgttgaaagaagtttgagctcgcccaaaagtgatatcgttggggagcaaatcgtcgatcgagtgcttgtcgccatctccagccagatcgaggttgctcacctgctcgctgagctcgccaaccaagcccgaatcggctccctgggcaccagtggtgctttcctcgtcccgctcgtccttggcaagtgctcccagctcagaatcggcttcagccacagatccaacaatatcaagtcctcgctcaaacccaggcgccacatcaaatagtccgtggctgtctctgtgtaacaattggccctgttcctgcttctcggccagatccactccgccgggcgcaaacggcatgaaaccagaccgtccccgcacaaaatcgagcttggaaccggccgcacggttcacagacatactatttttgttgttgagatcgccgccgctcaccgtgcactctttgtagcccgtaatgtgaccatcaatgcccagacgatcaaactgcacatctgtacgcactgtggcctcaggaagaccgtacagcgcgggcgcaaactccaccagcttgtccacgtggaaatccttattgatgtacttgagccagccccgtgacagctccggcttgggcgtcagaaaggtgtgcgtcagctcgtcctgagtctgttggtgggtggggggcgtagacgaccactcactggaccgattcggatcgtattcgaaatctgagtcggccgaggccatgatggttgcggtctttccccgcaacgtgttcagaatgtcgccaatcgtatcgctcatgacgttgtttgccttgtgacgttgttaaggcggtctagtccatctcggcagactgatacactttgctgtaggggttagggtagatggtagcaagatatgagggagtaggagggtgtaggagggctgattgtggggggttttttttggatcaattgagttgttggagttgtctgggtgtcatggtggtttgtaggagagtcggatatgtcttttactcgtggtgtggttgtacttatggttgtacttgcttgtatggtgttaagtgagtctacggacttcagtggacaatgttggtaaaacggggtttcattggagatatagaataaataaatagatagatgggttttttagggcacaaattgaactaatgtgtacttttcagttgacacttccttgaattggcaacttttggtacttgtacttactgcagccaaagttgaagtgtctacttggaagtccacttgggaaacatccgcgttttagttgaccatatgtagtacatgggacgtctctatctctgtcaatagtgtcgctagaacgacgagaaaagtgggtatttcgtaagaatgaagtaagccgtcaatttaagtcacttgtaacttatatcgcccctatatctctgtctgtctgaaacactcataatcttgacccgcaatttttccgctaatcttccaatacaacccccatttagacagcacaagagaacaagaggatcccaaaaacgcagatttgaaacgaatattatcaaacacgtgaccaaacacctcccaccttagtcatcaagtctgcccaaatccgcccaaatcatgtgaaatcaaccccattatcccgcagacccaataaacttccgcttacataaacacatttagagtttgtcagcttgaactcttagagatctcctgaaagacaacaaaacagctcttcgagcgattattccacaaaaacgaccttgccaatcgtctcaacccgccgaaaaaccccctcaggccgctccaaaccctaatcaatcacctccccgccgcgtccaagtttctgttcgcacgtgactcccaaatcaaattttaagtgtgcaaatttcacacttctcactactccaccaccacaatgttcaaccccgttgctaccggctttcccagccgactgggaggcgtgcggttctaccggacgcgagtggcgcaccacatgcgaggaaaaactcggttccctcagaaactgatccagggcaagactctgctccgtctgcagtacgaggactggttcggtaagcgcaacatcaagggcgacgccatcagcaacaagtacttttacccatctcagcaccatgtgcccaactacatccggccccgagaggacgccggtaaccccaaccgggaggacctgaccgtggcagcgccctctagagaggatccgctggtgcccttccccgacaacccatacacccgaaccaacacagtgatccccgagagcgtgcgagaacacattatcaaggatgtgacggtcaactccatgtctctggaggacgtttctgtcaagtacggcattcagctcgttcgattgcgagctctgttgaagctcaaccaggttcgacagaccttcaagtgtgatgtgagtatgagacaccccgaaccagcgacacaagatggcattatgatgaacttcaaaaaaaaattcgattagtcttgaagacaacccaaatggttagaaatttttgttttctgaaaagcctcatgagtgtgattgcaaccaggatcacccagttctttccctaacacagcccaaatacaagaaagatctcagcaagttctcgtcgtccatcgtggagatgctgcctcgtctgagagtcaactacaccttcaaggaggaggacgacaagcgggagaagcgggtctacttcaacaaggagcagggccagcagaacttgtccgaagtgccggtgccctcggccacccgaggctcgcggttcatgactctggccgagtccgagccctttggtcctgtggagtccgccaagctgctggatctggctcctgccgccgacgtgctggagaagcttcagcacgtggtggccgaccattctgaaaaggcggagattgagttcgagaaggccaaggccaagggccagattttcgacgtggtcaagaagtccgagtccaagcccgacggagtcattttccgattcaagaaggctcaggtcggcaaggtgggccaccgatacggcgcctacagagacgaccgaaagaaggacagacgggtggtgtacgaccgactgggcaaccgtcactgggccgtttaattgtaaatagtggtcgaaagacaaaatgtacatgttatgataggtggtcgtcggattgtattggacgtagcttgcgggtcgaaccgagtgacggacactgtgagcgagagctggtgttctacagtgcaagaaaggtatcactgagactgtacaggtatcacggtgagcactgtaggtaggtagtacatccggtgtagcctgagaaccatgtaagatcagattgagcaccgatgaacctccaaaaagcaggtggttggaaccagcagaacaagagctttcgattgataccatgaacgtcaagtgaccatcgtttgtggtgacccaacactaccgttgacgttttcagagtcattgagcacggggaagaagtgagacagagagaggacagaggcgcgggatccggatgaatctctcgagaatcttttgtaagactacggacttactattggtcatctctgcccagtatttgcccacgtatcacgccgagcagtttcatatgaccaactctcagcctaagacatctattccgagacgataatgaagacggttgagatcaaggactaaagaacatcaatagttgttcattcaatgatacagaactatagaagaaatatgtgactaagagatctgcgactttccagcctggtagacgaactccggcgtcagtacacacaactcgtctaatcgcttcatcgacagtcactggagatgtttactctgatgtttacgtactggtgacgagacctaccgatataatacaaagagtctgttaaatacggcgcacaaacaacgtctgacactcctctccttccaccagtatctatcctcacttctagacaatctatcctcacttctggacactcatgtggcactgaaggtgacaatcgaagcgccattgccgaaagaacatcgacattctcacggctgctttggtgtctgatcgcccacacacagttcagcggacagcctcaccaccgatctcgccccgaccgcgcgctcacctgccgttcaatggatacgtccaatgccactagtctcacccaaaagaaattgcgactaatgttgtattgcgtattgcccaattcactcaacctaagtggaaacagagtcgacgatcatataacaatgttccgataatagatgtgctcgatgaccgcagtactttggttccacagttttcggagaggcgatctggtgcaacgagtcgattgtggctgtgatgaacgttagataggcaacactcagggtctcctcaccaactcgtctcctcaccaactccccctgaacaccgactcatctcctatctaagcccactccacacccaagacaatccaactctgacctcgaaatcctatctgactgcagcatgtgtctgcaatagtgccctttgaggggacgatcggacagtcttggggtgacgatcattaaatttccccggagcctccacccacgtgcaactctaagcccagattagtgctgagacaagcacatcgtcttcaatggagccattgagcggagtccgaaacaatgtccattgagacgtacccggagagacgtcacaaaacacggccgtcaaatgccaagaaacggcatacacaatcgcacttggcacatgcattggcatcgacgataagaattggtagccttaattagctcgacggaaccttgtcctgaacgcccaggcagattgggaacctagtctccaatgtttggccgtatcagtcggtcagaccaatgccacgagcgtcacagaaacgtgctcgcaagctaagcgaaacagggcggaggacatataatgtcgcttcaatctccctcccccggtgaacaacaagcacaatggtcaatctccttgaaatctccacgggactgctggctgccgccgggctggccaagcgagccgacaactcgtcgtctcaccacattgaggtacccaaccttggcaacgacgctctgctggagtggggcttcaccgaagcccagaaaatcttcaacacctcggcctccaactgcacaaagtgccagcagggcatcaatctcggcaagtacatcactctcaaggcccccaccgtgacccctaacttgctggtcaagctgtgcaacttctacaagtggcaggacgactgcgacacctggcagggaaccgacatcaccaagggcaaccccggcaagcacctgtcgcaggtcttcactctgatggacgcctttggcctggacggccagaacctgtgctactggcacgccgacaacacctgcgacgccgctcctgttcccgcacccgatctctcgtcatggtggcccgagaagcccacaaaccctcccaagatcgagtcctcctacaacgagaccttcaacgtggtccacctgtccgacttccatctcgatctgcgatatctccccggccaggaggcctggtgcgacgcctacatgtgctgcaccgtggagtccaagaacaagaaggccatcagagctggtctcaaccacactgttcagcccgcccagaaactcggatcgtaccactgcgacgcccccgatactctggtcgaagactccatgaagtctgtgggcgctctggcccacgcccgagactttgaatttggcatcttcaccggcgacatggtctctcacgatctccaggactggctgtcgtttgcacacacctaccagtccgaggaggaggtgtactatctcatgaagaagtaccttggcgacattcccatgtatcccacctttggcaaccacgactcttacccgtactctcagctggcccagaactcgtccggttttgccggagacttttcctggaacgccgagctgtccgccaagctatggaaggactttggctggatcaacgagaccaccgaggcccaggccgagcacacttacggctcttttgctgtcaccaccaagcgaggtctgcgggtaatctccatcgactccaacttttggtacggcgataactactacaacttctggaacatttcccagcccgatctgtccggcaccttcaagtggctggtcggcgagcttctgcagtgcgagcgacagggccaaaaggcgtggatcatggcccatgtgccttcccaggaaatggctgcggttccctggaccaccgaggtcttccgacaggtgatccgacggttctccccccacgtgattgccgccaacttcttcggacacacccatgccgaccagttcaacgtcttctacgaggaaaacaacaagtggaccgaggactcggccatctccgtgggctggatcacccagtccgtgacccccatcgacacgtacaaccccgcgtggagatactacgaggtggacaccaagacgttcgagatcatgaactccaagaactactactcgcccctcaacgaaacgtacgagtataacatcaacaagtacaagaacgagaccctcggtaacttcacttacaaggtgtacgagccccagacccccaagcagatgacctggatctgggaatactcggcccgtgacgcctatgaccccaataacacctggcccgataacgcccctctcaatgccaccttctggcaccgagccgccaagggtatcattgagaatcctgcccagaaccagctctattacgaccattactaccgaaagtcaccctacacccagaagggctgtggtaagcagtgtcttcaggagacatattgttcgtttgttggtgggtctcagggtgagagatccgactgtctcaagctcgaaactcttcctactttgtagtagcgttaataggacatgtcaatagaaaagatttagaaagtggtgtcagtagggtgtcatcggtggtctcagagggttttcagtagaatcgtcggtggttgatatcttcgatttcccttcgtcaccatcttgtagtatctcgaagggtaagtcgatgtatctccgtatctccgtatctgcgacgtatattcaacggaatctcagcaacatctaccgacattccatgtcgtcacggcaatatcaagcgtatctttgggtatcagtgtttgttctacccagttggcgcctccttcaactcttatagtctcgatccaaaccaccaaggttcttccaagggtatgagttagacatgagcgtgaactttggggtatgtactgtaggattggtgatgaaggcgatggaagggaatcgggggtatggaattgcggtcaagtcgatgttttcgccgaagttgatgtcttgcaaaatgtctggcttacagcagactgaaccagaaaacttggtcaactgacgattgagacagaagtacacacagtagtgaatccaacagtacatactgaacaatgtactaaaacctggttgaaagtgagaccacgtgagtagtgttctcttgaccatcttcttgtgatcttcttgtgatcttcttgtgatcttcttgtgatcttcttgtaatcttcttgtgaccatctcttgcgaccagcttgtctattagtactcttgtaggttgtaaatgagtgggtaggggagatctacagtcaactcaaccagccaggaaaccaaaaaccagaaaactagcaaatcagtaaatcctcaaatcagcaatcagcaaaccagaaacagacactttactcatgctcttggttgtactagtatcgtacagtagtcgtacttgaagcaagcatggactcaaccccagacagacaagatgcttgcacaacagcactactcgtacataccatactcacacaactgttgctgttagcaatgtcaaaatgtccgtggatccagtcattgagacagctgaaagagaatttgactgagagtgaagtctctgaaggtcggcctgtgtgatgcaggtggagtagagtgttggtactaaccatacgaatgctcttttgctcggatgactgcacttgtactcgtactccacgagctactcacacatactcacactctcctcctcactctcctcaacagcaacaatcacctcctgaatcatgtctcacagcaagaatacctccccggcgcaacagacggcacttctgtcttactcagacacgccacagttgaagaaccgtgtcagtagcgccagtagcgccagttgcgcccgaacaagtgccctatagtgcccgaacaagtgcacttccgaaaatgtcctcgtacgtagacatctatttatagccatttatgccacaattttacgtgctattaaaagcctcgtatttttgcaactctaaaagaggctgatgagtgggtccctggagcggctaaagcagctgctaaaccaacatgaggcgcatccatgtgtatttcaacggagcgaattcaccgacatttgccacagagctcgatctggcccgcaaatttgccgtttcccccgattttcaaccacattcaccacgtctagacgtacccctgcgacggccgggtaactccaaaatacctctgcctctgttctgctcggctcatgcgcatggcgataaggttgatctgaggaatggtgagacacttgaggacgtgtttggaaggggagtttcgcgttgatggcggatctgcggggttgtgggcgtggcaacgagtgcggtgagttggatggcgacgtttccgagagaagacgtgaaaaacgttgtcacagttcagcagaatctatttagttggaggttcaactaaggttcaagtagcagcaagtagcagctacgagtactgtactgcagccacttgcctggaggtcgggcgagaggcctgaattgctagacctgaaactggattggagtgaaccggtcatttggtcgcccgtgcgtgattgactctgagacaggttgcaagggtcgattgcgccgctttagcagcggtaaaacagacgatacttgtacttgcttgtagatgcaaccttgaacagaacgttctgacaaacttgaatgttagaactccaatgttagaactccaatgttagaactccaatgttcagacaaacttgtgttcagacaaacttgcgttcagacaaactggaatgagagaggaatcacattagtaagcagaactcgaggaccgtgacatttttacatgtccacgcgttgaacttagcaacagcggccaatccagatgcggccatttggtctgcacctgcttatctgccctgaactttgtgtgtatggtttgaaaaagctgaaaagcggaaaaagcaaagatagcaatggcgaggcgagaaggcgaaacgagatggcgagcagacgaaacggcaacacgaaacggcaacgcgaaacggcaaaaacggacagaacaggaagaaacgagtcgacggggtgacgcagagtgtcaacgatcgtcaatgaccagagatttccactccactacagtactgtagtatgtactagcctcggataaacctaccgtggctatatactgtagccgtaaatagcaagtggtagttcttgttggactgcgaggtgagtggacgtgggtcgggaatcgtattgtgcgtgccagaacagttcatacgtacgtacgcaccgttctaagacatacatacggttcggacaagttcatacgtcttgtaggtaccttctaggacggacaagtactgtaacgtgggttctcagacaggttgtaagtacgtgcttgtccaagtaccgtgctcgcctgtctcgcctgtccacacttgcccgccgttttctcgtggttgtcgtggttcacgtagttctcttggctcgtggttcgtggctcgtggttcgtggttcgtagttcgtggttcgtggttcggggtctcgttatatggtcccccttaatattaacccagactagaatacctgtagctatcaataactcaaagtactccgctcaagggctgtcgttcgaggggcaagtatgcggctgaatggttgtgaggggtaaatggtgcgggggagccggtttcggtccttatatagctctatcatgcccttatccgctcttcttcgccaccatcgactctgtggactggcgccaactcccagtgtacgcacaagacaaggtgtacgcacatagtgacagctgcaggttgcattctgcttgtcgccatcgggccaaaaccctaaaataaaagggaacacctttctgaacccaaccgcgagagctgctcctctgcaacctccccccctgaaacaactctaccgacgatggcgatcccccgaagagtcacgcgactgatcgtggtagcgctggtgctcggcggactgctgcatctgctgttcgctggcagcataggccgcaaacgatacgcctttactaacgacccccaaacaggcccaagccaaccgacaccggacgagggcccacaggaaccgcagtacgcggtggacaatgtggtagcggagccggacacgtcgcatctccaactgacgccaccggaacgcgaggagctcgaaaaacaggcccaccaagaggtgacgcaggaggaaaaagaagaagccatcaacaaacacctcgacacggccgaacacaagctgtacgcgcgcgccttctcggccttctacgaccagcggccccagcgtctggatatccccaagttcgacaagtacggcgatctgggcaagctcaacgaagacaagctcaagagccagcgactaacagaagaccgactgcggcagtttctgcagattgagcccaaacacgtggaacagatggcagagctgcacaaaaacctcgtcggcgaactggacaaggtgctcgacgactttggagacctcacaaaaatctacaagggcactggtatcgccattgtggccggagcccgcttcatgcccattgtgaccaactcgctgcggatgctgcgacgaacgggctgcacgctccccgtggaaatcttcctggccaaccaggaggagtacgaggtgcagttgtgcgaggaagtcttcccgtctctcggagcggagtgccgggtgctccccgacgtgctgggaaaggccgcgctgcgaaacttccctctcaagggctaccagttcaagattctgtctgctctggcttcatcctttgagcacgtgctcttgctggacgctgacaacgttgctatcaaggacccctcggtcgtgttcaagtccgacgtgtacaagaagtacggctacattctgtggcctgactactgggagcgatcaacccatcccgagtttttcaacattgcaggaaccactctcggaggggtgcgtgacgacatgaagaagggcggggacgaggacaacgagcctcccaaactggctgatctgatgggctccatgcccaacccctcaaccgagtctggccaggtttttgtcaacaagtctgccaaattcaaggcactcctgctggccacctattacaatctcaacggaccccggtactactatcctctcttttcacagggtatgatgggtgagggagacaaggagacgttcctggctgctgctgtggtgctcaaggagcccgtataccaggttccccgacacgttcaggcaattggacgatggtaccgagactcattccatggtgcagccatgttgcaatttgatcctatcaagacctacgagctttacgacaaggctgctcgtggtgagattgacgaccagacccgcaacaagctggtggagaaggagggcatgttcatgcatacaaatttccctaagatgaacccccgggagctgcttgagaagaagctgttgaaggacgctgagggcaacaagttccgagcgtttggacctcggtccggtcttaacgggttcctgcccacccgggatctggagctggagatctggcaggaggccgagtggatgacttgtcgggatatcaagtttgccaactggaagggtgctgatcgggaaaagctgtgttccgaggtggcagaccaggtggatttcatgttgtcgaccactgacaagtaaaaggacattagggcatttgaaaacaaaaacatatggtgcataggacgaactgggtaataatagattgatttacatggaagacatgaagcatggtgaaattagatggtacctggaggaagatgcgagacctgtttggacagcgcccatgtaagtacaataggacaggaactccaccactaacaataaactgattaataattccttgggtgacaacaagaatcaatgtccatcctacctttcgatacaacggacagccacgacgatttcaacaatctcacttggaacgcaactggttgaaatcaggcgatagagtgattctcctgttggttctttccccagttggtctctacgataacgatctcgggatgttttccacatgtcttcatcagtaagcaatgaagagacatcatttcatctttcatcattaggagtgttggtaacctcgttggagaccgagcgatcgagggacacttgtatttctttctcggggtttagttcgaacttgaagggcatctttggtatgtgatgttcgactgagtacggtacgagttcatattgtacgcggttatctagacctcatgatattgggatcttctcttcactgccttccgacctttgtcactagcatccgctgtcaagtagacaccaagtgtccgtttgtcatttctagacgtcagctggtgtttcttgtgatagcgaacttttctctactgtctctaaacccgtatggattctccgtttctttggggcctctcaacatgcaatggagataactaaagaccagaaacttcactatgagattgcagacagactgagcgtcggttatagagcccattatcagagaaagacatgggagcatctctgttgactcgttctcctctatccccgccagctcgaacagcttgaatgttggagtttgtcaagtcgttgaatccgagtctggatatgttgcaaacgtgagtggaagggaagaaccagaaaggatgtacctctcgtagtacagaacgtagaacaggcattggcggagcggactgcattggcggagcggactccaagttaagaaacgtctgcagacttgtgggcgatgatgctataggaggaacatggagtggctgctgttcctcctgggttagaagacagagcatttggggtttcaaattcgagattcaggactcgaagatacagaactccaagcttcagtagctgttgtagttcggtatcaccaacatggcgatactggtatgtacatactggagggtacagtaccggtctggacgggttccggatcggcagtccatcgacagtccgagacatataggtatacccagtaaccagcagtgtacttcaaagtgattcatactgccttccaggggaaatctagtacaagttgtcgagtcattgttgcgtcagagattgagacgctgggaagaacggagggactggttctatgtcagatcatggagttttggaaaagtctgaaaccgctgacaacagtttagtatctgaagttctacttggtctccaccaccatggagcgacagggaggcgcttgcatcaaagccggtctgggcactatcgctgctgcccgagaaaacgactttgccattgttacctccaacctgcagtacctggctgaggccatcgacgccatcatcactctgcttggacgtatgtatgacgccaacatataccagactctcactgctgctgctccactgactacggtacatccagcgatgcaggcagccctgaaggaggagactgcgacaagaggcatggtaccgttgatgtgacattgccaaagggagtgagtacctcaatcggacccattagtaatggcgctgcttcatctatgtccatcatggaatgatgcgttccaactattgatgccgatactcaaaagggcacagcaagacatcggtgaagaatcattgatatcgattggttcgaaagtgatggcataagtcattaaacaattattttttttcgtattgtaagaaaaaaagaaatatatccgtgaaatagggtgaaatcgacaaaatgaacccttctttatgtttaaaactgtggtgggaataataatattagcccaaatatcgcctaaaggcaatattcagcaagatatttgttaatattcttgaaaatatgactaagcggtcgttaggtttgctacgaaataatacaaaaaaaacagatatcgctgatgtggtggctcaatggtagagctttcgactccagtcaacttggttgtaatcgaagggttgcaggttcaattcctgtccatgtcaagttctaatagaactgacagtggaggaaattatgggggttaaattcccctagcttctagctgatcagtgatattttttgctgagagagggaatgttgtattgtattttttgtacgatacgacttcagttcttctcctgcccattaggatcctacaaggctcatcagccgatgagtcagccgatgagtcagccgatgagtcagccaagggaatgtcacgtgcatccgaacttgtctggacattgtaataacgtctccatcgtaataacatctcaataagtcttgattcatctcagctatttcgcaatgtcgttttttcgactaaatgaagttgcaaaaatcgatttttgaacattagtaagctggaagaagccggaatacctccaaaacgccgatggtattgataaaatccatcgttgccatcgatgggaacccggttccattccgggtcggcgcaaccggtgaaaatacagcatccgacagccatagtcaagcaccagagagcccagctcatgcaccagagagcccagctcttgcaccagagagcccaggtcatgagggtggcgagtgggctgtcctttgtctcatggctgttattgtgctattcacttttgcagcccctaatcacttttgcatccgtcatggagtctcatggagtcgtcttgacacctgccgtatgttcagatgtagaaagggaacgagtgcacgtgcgagcacccgcaaacctgttcgtaaagcaacagctatacgacctcaatttactcatggctgaaatttgtattgaatatggaccattatcctcgccttctgaccaagctgctctttgagtatgtcccgtagtttgagtcgtctgagtagttcgctagttcccacaagccacccgcactgggaatgaaatgtaggtaaattccaattgtttcgaatggtgtcgggttgcgcaaactattgataaatatagagctcaaaggtgtgctccttgggatgtgcctggttagccatcttgaaacactcctgacaacaattgaacgtctcacaatcaacacaatgcacatgtgtcttatccagcagcttgtcgcagctgttgcactttgggggtccctcaggaatagaccctacctcaggtttagtcacaggttcaggatcggccacagcgacataggcatgtcctgttttatgcttcttcggactagaggcacctgcagtggtatgtgattcaatagggtaccgtgtactatctggtgaatcacgttcagttgtggtagggctggtattttctgtgggctgattattccgtgtcgatggaggcgacagagactcctcgggtgcaggaattccccaagcacaagattttgacctggcagagggagagcttgtggtgggggtttcctgagctgccaggaactcctccgaaaaggtcatctgttctgtcttggcgcagatattgtcaaggtcgtcctgtcgaaatgaaggaaaattttcttcagtcttcaccagcggtttgggaatccagggcttgggatgttttacaaccgacggcttaaaagaacctcctgaagctgccgcgtagctgcggttgggggtagatgctgtggacacggatgtcgcagttttgatgttctgttttaccggctcgtcttcctcgtgaatcccaatgcaaaagctctcccattctggctctcgatggatcttgtcacgcaactcgctaacgtattcgcagggctcatatataccagactgggtcaaggcgtagactacagggacactgtccaggctcttgatgcaagagctgacgtgtttggggatagacgttgtcttcgtccctgcgggaattcggaactgcacaagggtagagaaaagctctggtttcagtttgccagctgagccaagttgcagttttggggaagcagtcttcttgggacctttgagaaagccttcttcaataatatcaacgtcttccgaaccctgagacttgttggcctgttccagagtgtccagtttcaactttagagcccagacgtcgcccctgagagcggcgatctcctcactagcccgctgcttgatttcgtccatctcttcctcaaggtatgcacgcatctggagcaccgagtccgccaccgtctccagcttttcatgggccacatggtctctgatggcattcatctggttggtaggacgaatgtaccacttgggcgagttggccgctttcagcgacaaccagtttccgaccacagcctcgtcgaccgggatccatcgctcggagccttccgtcaatgccatttcatatcccttgaaggtctgtggggccttctcgaacagctcctggaagtagctgtcgaactcagccagcgtgcggaaatgcaaaccgggctcaatagacacagattctttggtgcccgcgtcggagccaggctgtagaatgactcttctcatggtcgtaggacgagtagttgttcgatgaagagctagtccgataatagttgaccatgatgtgttgggtgcattaaaaatgcattaaatatgcatacacaaaattaccataataataaattaaacatcaaatcatagataaataaataaatattctagaacgacgctgcggagagagcgggctcgactataaatattctagaacgacgctgcggagaaagcgagctcgattataaacattctagaacgacactgcacagaaagcgggctcgacaacgatgaactctgtggatacccgcgtgagccaggacatgaccagagcgttgaacttgaagtcgtccagattgtccacaaaatcagaccgcgacttgagtgccgaatccgccttgcgcttctgctcaggtttccacgttttgacagacgtgggatccatggtctgcgcaaaaaagccaaacatgtgtcggatgtatgaggaaggcttctcagactgatgggaaaagtccaccagattgtccaagaatgtagcatcgagaatgcttctatcagcagagcaccgcgacgccaactcaccggcagtcttgccttgaatgtactctcgtagaaaaaacacggaggcacaagagtgaccaagcttgctcatagtgttatctgtgccacaaaagagagcttgcaaaactcgagtctgtgcagacttgaggtccacagtgtcacataccaactctagggcctgttcgaccgtgaactcatccttgccaagcaagcaagccatgccggcatatgcagcactggtgtcggactgcaacgagtccagcgaggagtccgaagacactagcaaaagtagcctgaacagaaattcgatgcagtcgggctcaataagctgagccatagtgtcgaaaaagtcagccaacgattcggcgcttctgtatcggaagggagggggaggctggggagttttggctgtcttggagggagaggccatggagaaggaggcaggactatcaaaagagccgatgagactgaaaggcgaatccattctaagtgccttgacgggagtaatcggagtattactagacattctgcctggccgtttgggcttgaccggagtacaaggcatgctttcagttcgtcgactcttgttgagaacagagtaagcactagcctggttctcacaactacccttccgcttgtcccagtatctcagtccaatcgccttcatgaccttctccatgtggtcccgagtgagcttcgtatcagccttctgcaaatgagggacaatgtgctgtcgctcgacactggaagtctcacgtgcaagcttcaccagaagccactgaacatcgatcgtgctaaactctagatcgacagcctgtcgaggaagcacctgcgagggtctcagggacgcctcattcatcaccctgagaagcttgtgacgaggcgcgaaaccgatgctttcagtatcgttggaaaatacctcgacatcagcggtttcacactctatgagaggagcatccatcaactgttgcttccgcttagtctcctcctcctcctcaagcttcttgtagtaagcctccttcttctcctgatgctgctggattctctcagcctccttgagcttggcagcctggtacttgacggccacctcgtcctcaggtgcgttgcttcctccacgaggcgtagtgctcgacgaagtctgattcacctcctttagaatctccgccagtctgtcttcggctcgctgcttgacatccacatcgttgtacgatatcttgagctcaggatcactttcgctgtccatgtcaaagccatcaaagtagctggtgcttcccggacagtcactatcgaaaaggccatggtcagagtctggcgatttcgggttatcaggggatctcttgttattaacagttcgcagaggtcggggtttagtgggcgacgagaaaagtccgtcggacaataggtcctgtgcggaggaaagagacatggaagtcgggtccgcagtgtgcacataccgttgtaccttcaccggcgatgaaaagacaccttcgctagaaagatcttgcgcgggcgaaagtgtcgaatcgtcactagaaagatcttgcgagggcgaaagtggcgaagcagtcattgtgggagagctgctaaagtaatactgaatgtttttgttccggcttgcagaaatcggactgtcggaatgcgtttccgggatgacttttgaagacgtatttttgagagtagatctcctgcgaggtgatgtcttcctgggagtctttctcacaagagcagccttccggggggtcgatggtctcggtatcgacttgcagggcgctggcgttatctcgcttttcttcattaggatttccagtttcactgcaccttcctttttggtggctcttcgtttgggagatctagtgtttccaccctccacagaacgcttctttttcctgtctagcggagtgctattgatgatgcgacaatggaaatctctcagttgatggttgacatccacgggcgaggtctcagagctgctaataatgatcaccgagctgccactgggcttaaccgtcgtatcatcctgtccttcgcaggattcgtcgtcgctgctgaagatgatagaatctcgggtgctccgactatttgtgggaatatctgacgatagtttgagatcgaacgaaggaccttcaaacttatctggcacagatcggttcagcttgctcatgaaggactctcgcttcatggcggtcgtatcttcctgtcctccacaggattcgtcgtcgctgctgaagatgatagaatctcgggtgctccgactatttgtgagaatatctgacgatagtttgagatcgaacgaaggaccttcaaacttatctggcacagatcggttcagcttgctcatgaaggactctcgcttcatggcggtcgtatcttcctgtcctccacaggattcgtcgtcgctgctgaagatgatagcatcttgtgtgccccatctatcttccagtcctccgcaggattcgtcgtcggtgctgaatatgataacattttgggtactctgtttacttgtacggatacctgacgactgttcgagagcgaacgaaggaccttcaaacttatctcgcacagtgcggttcagcttgttcatgaatgactcgcgcttcaaggcggtccgtatcttcttgacacgaccctcgggtggagtgtcatcgtcgctactgatgatgataatctcttgggtgctccgtctatctgacaactgattactgagatcgaacgaaggcccttcaaacttatctcgcacagtgcggttcagcttgtccatgaacgactcctgtttcatcacggtcggtatctcgacaggatcctcaggcggagtctggtaatctgtgtcggagctgaaactgctgccagagttggaaccgctgccaaaaagttgctttttgtgctttgcaaggggtgttgtgaggtaggaactggacatgcctgactctggtgtttcttgaaccgcagtcactggacgtgagctgctggccagacaggtcgggcggaggtcctttggggtcgatttgatcggcgactttcgcagtttcctcaagagcggtttatttggccatttgtttgacattttctttgattcggatgagagcgcaggtcgtttcgaggcgagaagcttgcccttggagaagctgaggaagctctgtttgtccttcattttggccttgcttcttggccgacgctgtttgtccttcattttgcaagtcgaattgtccatcaaaccgaagaggaagggctctcttgggccacaaaacttggtgatttcgcgatgtagttgtgtggaataaaagaggtgctgctgcataaactctgtctcgtgtacgcgttctgccctaatgtgcagcataatggaggtacgcgtttggcaagaaaaaacaaactgtgttgtacgagtacgataccaccatagagaaaggtggaggaatggcgtctcgtcgtgtcagtaaacctctattggttgatttggattgtcagtagccgtcaacttgattttccttttttattatttttcctttttatatttttctttttttctaaaaaaacataacatgccgcgcttaatcctctccacaaaagtaccacaacatgtcaagtaaatgtatgatggtttgttagactcaaattgaacatgaatactgcacgttgctgtgcagaaaatataaaaaatatagaaaatataaaagatagaaaatacaagaaatacaagaaaaaaacaaggaaaaaaggagggaaaaaggaaggggggaaaaaggaaaaatacaagttatacacattggcgaatcagctgcccgaattgctttgcgcgaatcgaatgaaggaactttgaagggttttgtttcaatagactagaatgtatccataattcctaaagacaaccatctggacataggagctacatgcgttgtacgtacagtaacagtaagacgtgcaacagagaaggaaagtagattacagtgagacagcactacggagcttccaaattcaactgtcattattgggtgtaaaattatccatgttcccttgtcattgctaccattctcatgctctgttggctactgtacggaatatagccagaatgaagatagtctcttgatctgtctccttaaaacgagcagtgacaaacacaatccagggcaagccagctcgccaattctgcccaatcgaaccgagtcatccaattcttccggcgatctcttaatgtcgtccgccttggatctcattgtcaaactcccggtgggcggtgtctcctctggctaatcatcatcaacattgtaaaccgacacggtggatccgccttaatggcgtgctctgaagcagtaacctcattgtcatcgcatgctacgttcttcacaaatacatctcgtcttccccagcgattctcgtcggctactggcgatgtcgcttgaatgattttgccagaatgggctacatattcattggcgtgccattccacatatccaacattcaccacttttcagctcgtgtgtttcttatcgagcatttcttatcgtgcatttcttatcgtgcatttcttatcgtgcatttcttatgcactatcccacatgtcgagacttggcgcagtaccagtcagaaaacctaccattgttcggttagcccaagaattaccaaggattgttgaacgtagcatccggcagggtaataccggaatggttcctcatatagggataagaggaaccagctaggccgtaggcgaaatgtccatctgttttccacggatctatttgtcttctggtgaatgagcaagtacacaccagcacacatcagaagagtatgtactgccatcgtaacgtaccaatactaccaatactactctgctgataacacatctagtacagatccagacttcagcaccctctccacatagctttgcaaccctcaacagcatatgggaggaaactgactctgttacctctatcagctggaccggtgggagtcggtaaaatgattgtgaattattagagagggttgttgggaattgtcaccactttccttgtacttctgtgaacaatcaagggctattcaagactctgaagttcgtctcggtccgacaatttagttgattgctcttatgtggcccgctcagggcgcacattaatgcacacgcccttacaatctctccagttaccaatccacaaatgactctacaaccaaaccaagctgaaatgcatttagaaccgcacatgttcaacacctttcggggatgtcggcttttgggcgcttcccttcacagttgtggcaaattgtgattgtgaagacaactccgagatcatcatccgagtggcccacagcccatcgttactctccgaagctgactccagaaaagctggaccttcattctccatgtccctacggagtcaagccttgtttgtttctaccgacggggtctggtgttttagccgcctgcccaggaagcatcaactgaaaacggatgcctcgcaaccactcaatgtgctattgccgacagaccaagcgtggccttcaccttctcacttacctgcgcccggcataccagaaacgggaaatcgagtgtctggactgttcctgaccgcactgttcatgggtcattctcagccacctcgtgcagagagcgactcttgttccacgagaccaagacgcagggccgattggatctccccaaatggtacaatagcagctcaagaatcgtctgcttgcgatgggaatgtgtcagtgtaccgcatggttcggagacaagtgagaagcccgccacggggcaatggcggagttacggggcagtggtggagttacggggcaatggtaagaatgtgaagctgtttgctgggcggttcggctgctagtttcttggatgagcaagtccagcgcagttacttctacttccacacaagtgcgagtgtatctcagggacagggctgcaggcctttcacggcaaacttgcacttacctagacagttgtttttccagagcaacttcagtcccgccaaacatagaccaggtatttatatacatcagacaattagcgaactacttttgatcacacaacgtacccacgacagatattaagcccaacgttgcctttgccctttttgccctgactgctcctgtcactgcccagaaaggaggctggggggggaaaccacaaccgacccgataacggcgggcccaattatcccgagtccaagggctaccagtacgagctcaaggcgtttgcccccggaactggtctccacagccagcctatagagatcaagggcaagaccatggagcttgatgacaagtacaagcgtcctgacttcacagtcgagtaccacaactccaacgtgaacatcaatgagcgaggctggagaaagcagcgaaagcacattgaagtcgacggacagggcaagcttgccgttgaagacggacggggtccgcccttcgtttacaactactgggagttcactggagatcaggaggccgtaatgcctttcacctggaatggcgtcaaccagttttacacttgtggaggaggtcctatctatgctcgacagggatctcccaagtgccgcaacccccagtacttccagctgattggataccgttcttgatggtgattgtattgtctgtaactaactcgcagttctattatcacatgtgtaaatggtatcattgcgattccaccaacaatagatcattctatctgtatccaatgccttccaatagtactaggtctcatcttggggcgttcattacgtcttctacacgatcaaaacggttgatttctaatgttcaccgactacttccgctaccactattatggcaaagaccatcgacagatcttcacagctccccaacagtctgaaggagttggacccggtcagacaaaccatcagcacaccaaagctacgaaacttcaaccctttcctttgtcatgttctcaacagcaggattccctgatcatccccataaaggccaggagacctgtgattgatggaactgttgaccatgaggactttactgcaccaaggtactttgaatggtgaacgtccgcaatttaggacgagatctgaagacctctgagatccctacagctcagtctgacaagaaggatcttacggtcgatatcatctcagcttaggctatgggcaaggactctgtcaagggcttgttaatctcctgtctggtaccttgattacttccgaaaccaactgcgacggaacagaaatgagccagacaattccttctggttttaaccctctgctctacgtcatgaacggctctgtactgctgatgccaagatcatagcctcttttaaccctccctccattctaccatccataatgtcataatgattcgatgcctcaaagatccagagataccgtcataaagagatccagagtcatgctctcgaaaatgttcgtgtttctgacctgagccctgaactcctcagaggagtcttgcccccccgtccttgtgtgtctccattatggtcttccttggcatggcagaaaacattcgccgaaatatacatgcaacaataactcaactcagaccgcaactgagacttctcaactcagagtagccagagtttttctctaccgaatccgaacccgccatttgttggactcaggccaaagcggatttcaaagagttcattcggtgtttttaatacaccaagagcaccatctcttatgccccaacatcacctgtgccaaaattataatcgataaaagtaaacgagtaaatctcacgaaccagttccgccgagaacgtgagtgacgctagtctggtttcgtgtctgtgcgatcatactcccctcttgggtcccgaaggatgattgcaagctggtttgaaactgactgggttgtagcgtcgtgtctaaagaccaaaattgccagtagacacgagttttcaggggcactccctatgaaactctgtccctgagctcatagtatgattggaacctgggcatggttaacgcataccctccctataaacaacataaatccctccctggaattgagatgtccccccggagactctggcctgactgtgcctatctgacaccctcggaagatacagtcgcttggcccaaagctctttgggaagcacccgtttatgactagccctatctctggtagtaactagatccttggacgctcatatgagtaagtaatttgaagactggtagagtaaatgacactggcaactgtggagtaacacttcttgcagctgagactcggttgaaagatgataaggtgtgggaatcctaagaagccggtcctgtgtggttgtctgtgtcgtgtttgtgtcactcagtgttgtgtttgtgtcacatggtttcgttggtatccgtcgtcgaaaagcggggttggtgatggcaacagttactgtagttgcagtgtcatcagcttatgtaacgaaatagagattcccatggagtttttcatgttgtcatatcgaatgtcgagctaacgtaccaaaaattccgcagtggtgccagttgaatggaagaagggataaatactcactcaagccgcctctttcttagctggcgacaaaaaaaaataacccgtcattttcagtgtttgagacaaaacacgtccttggcgagttcttggcgatgatggttaacatgaatagaggattctaaagaacaaggaaattgggcgggtatttaaaggttattctctcaaagcaaagttataattaattgaatgtatatgagaaaaaaattttacacgagcagacaaataagctatagctaatatgcgaccttaaattgtggtctaattttgttttgcggggctcctctcaagagggcttatataaaatctcgaattcgactccattcaactccgattttgacaatgtcactttttgagttccaagtagtgcatactaaagttttcatatcattagtacctgcattttcaaatggaagagtcagaaatatatctcgacggtagtttatgccgaatggaataagcttcaaaaaataaatgattaagtggccggattacgtggcaagtttatagcattggcggcattacaagtttatggtatatttaaggttatggaattacatttatagttttaatttccaatttagtaaacaaaccttatagtttgatatataaggttaatagcttaaatattctaaaattcttggagatatcgtaaattgcttaggtactgtactcttagtcggcaggttcgaaactagtagaattatcttacagtcacaatactgtagaaatcagtcagctacatattctaattcatcatcttactcttcattcgcgtaatatggagtttacacatgagaagcaaactcgcgcctcaagggttcaagcccctcattttcttattattatttcagttaaaataaattaagttaaatgcaaaaaaaactattttgagttgaaacaacattaaaactgggaatcatgacgatggcggcgaaagcaacagaaataatacgaaaacccgagaccgccgcaaaccctaccagtgcactgctgcatctggtctgtccgccgatatggctgcccaggccgacgcgctcgcttgtcgaacaacacatggggagatggtcagtcgaatgagtgccctcatggacaagaaactgcaggatttatacgccgaaattgctctactaaaggttcttgtagatgcgagggagttgtttggtttggaaggatagttagatgaggaagtggatcaggaatattatcaggagaatgatcatgaggatttttcggaccacgagaaaaataggactggtggcccgcctgcttctggaagatgtgcccgcagtgataaatgttcagtagagcaagtgtcatggtcgctctgactagcacccacattacccgaggaaaatctgtacaaataggattgcctgtctcaaagtcttggtgttagactggtttaaagagatgccaccttgctgtcgtttcctacccttgggcttgaacaggagaacggaggagggttacttgtccatgaactgaaagagagcatggaggcgtttctcttcaccgagactgaccaatggatggggatggtgtccagaaagtcaactgatcgggtcgtatagaccgttaccaagacgaggaagctcgcaattgtcgttgagccgagacaccgcggtggtcaagggatcaagacttaggcccagggggcagacctcaatatctcagcaaaggagttctacagccttggcaaattcctcaccctaggggtgatccaacgattgaataaattctagtaactaaaaacctcagtcggtcgcctattcgcagccttgagtacggtggcacgaagccgaaaacagttttcatatcccatcagagacggaagcagatgtatagggcagatcgggcagcgtctctttgaggtggagtgtactatacacgtctcgatagcctcaacgtgagctgactcagcagcaatagcagtctgtttagaactgatagcggagacatcagcggggtcagtcatatctcggtacgcctccagtttgtcactcatcttaactatgcgttgctgcacatcctagattgtcacgttcaaggatgcatatagtcctctcggagggtggaattggcgagattagaagacaatagttgtcataacggttttcttcttgtatggttcatcaagcgagagtctgggtgatcttttaagtgatatggtgtactcgttttgtatatatgtatgggaaaagaggagacttatatggacgatatcagagtaggactgacggccggagacggttggctgatgagtcaaagctgtacgattgagatgtacgattgagaagagttctgttacaaagaacatttagtgattcaaaatggggaattaatggtctgaatcaccagaatactccgggttgtttattcttattgaactacatttcagctattgtaatcatggtagggctacagtagtaaagcaagaataaagaactcagacttgggttctcagaagagcgtatgacagtcataatacaatttttcccttttttccgggactttttggggatttttcgcggtatattttccttaaacgctgctcttgtaccctttcccacccttagacgtctgtaacgattcagaagctagtcataaggtgttatgattagtcatgggccttggcacgtgactggacgatgatgacgtcctccggacgtcatgagtgtgtcattatggatgaatacttggtatcgcgtggctagggcacgtggatagtgacgtgctttacagagttagggttgagatgcctgtatacatagccaccactcgcaagtatgtaagtaaagttacgtttatacgacttccggagctcgtactattggtgtattgctccgctcgtacctagggatatcttgaggattgacccatccccgatccgttacaacgtcatccttccgcaatagtttagtggctagaatttccgcctgtcaggacacttgttcagcacgcgggggaccggagttcaattctccgttgcggagtttctttttgatcgcattctcccttttcgtctgtatttcgcgagactttttaccgccgtctcagcattgtcttggtcagcattttttttcctccattttttgcgttaaacttccgctaaacgagatgagctgaaacgttaaatattttggaggttttttctaaaaaaaaaaggtgttgaatgatccataatccaggattatccgtcatatatagatttagtaacttgtatggcatctttactcactctgagctcaacagtttgtgtctccttttaatctcccacgtcttggcactgaacccactctgaatattaagttttcgtgctgaaaaaaaaaaaaaaaaagtgaaaaaaaaaattagtgtcatgctgagagccagcaaggatatgaaaaagaaagcccgacgtggggcttgaacccacagccttgagatgaccttggaataagagtctcacgctctaccgattgagctagccaggctttgttgagaaaaccgaaaatgtagtctttaccatgtgaattgttgcctataagctgctcattagagtaaaaaaaatgcttgaaacgcaggaaaaacgatggaaacatgttctctgattacttccccagtcctcagtattgttcagccacttgtacaaatacaagtgttgtacctgttacaagagaatgaggacatgtaaaaaataattaaggaaaacccgattaaggttcggaattttcacagcttctttttacaaaacctgtttgacgaacgcatacccaaaggatgtgcaacaaaacatatgtttgaaatgggatctgaaacaaaaagaaatgggcccaaccgggaattgaacccgggacctctcgcaaattgctcaggaacaccctaagcgagaattataccactaaaccatcgggccacgtgaataagatatttgctctcacccaggctcaagaacgcgaaaaacgcgtttctttaaaagaatcattagaataaagaaaaaaaaacaaaaaaacagccagtcaagaaatgaaacagaaaaaaaaaaacaaaaagaaaaaacacagaaagaatacatcgacaagcgagcacgaatgtcatgcgttctttttaacaactttggggctataacaggcctcaattggctgaaatgtacttcccttgaataaaaatgaacattagatttttgtttataaaaacgtttagtttcctaaattatttaaaatgataaacacgaatctaaaaaaaataaaaaaataaaaaaataaaaaaaattaagaaaaaaataaaaaacaaaccaacaattttgtgactttcaggccccgcagtagaaacaagagagcggatgaaactggaagcacacgacacaccgtcagcaagacattttggatactgcaggtcgtttgttagattgtcccataatctgctattggtcaagaatgatcaaggagatgagagagtatacgaggttgtgcgacaagtgccaatggttcatgaaagggaccacagcaaaaaaaatgttctcaagcagctgcctggacctacgaagatctggtcggaaatttcgaaggattttgggtcagtcgaggctccgaaagtcaaggaaccgattccataatgtatgggtgatccactaaggaatgtgcgaatctgtacagtacttgacaactcttccgataccgcggagtatccccaccagatggacgcttggctaaacaagatgaagatggcataaaacgtagagatgtcagcgatagagacgactttccgctccagcaggcccaatagctgactttttgggcaacaaaggcgctctcgatctacctctacacggctctctgacggctaaccagaatcggccctgtctcgaggtattcaacgcgataggagaaacaggacatttcaaaccgccacctcagcaccagtctgctgtttttcgtgctcggagccagtgtggcctttgcatacaatgaagtatatatcttcgacaccaaatcgcgcaagaagtcgacttccaacgcgaatcagggcgagttcgcagagtcagccgccagaccgaacagctgcctggactaaaaggcccatgaggaggaccaggacatggaactggagattatcgggtcttgaaaggtggaacagtgccttagtccagtccctgaagcctttggggaccatcaatacgacaaatattattccaaggctgctcctgatctaatgagaacccccaaggcaagttcatcggtccaggaaccaccacaggcgcatctgagatcgtccggcaacagttaccacaactcgcagcatttcaatggctactttgccgtttcccagcctcatttcatacccagaaagttgctgcgagacgaatttgggtccaaaacgctctcaagccagagtgccttccaatggtcccacatttctgcagaaacctctcaaaggcccagtcgtctccagaagctcagaaaaaagctcaccgagggtatttacaacgcctttcacagaaactacaagcctccttctacggttgtgcctgaaacgtcgtttgatgcgtctcatcaggagcctcagggtcgaactcagtctgttttccatggatacgggagttatggggactaagagagcaaaagttacgaagatgagttgtttactgagaatggactacgacagatacatgggtcatcagccggatcatgctgtatggcgatctagctcgattgtaacaatgaagaaagcacaattgaaaagacccgctttttcaagtaataacccacaaggcaagtcattcaaaaataccaatggtactttatgaaggccctagaaggtataaaattagcagctatgctgcctccttcttatacactcggacagacacgagcttggttgatggaactacactagcgacctgtaaggtcaaattaaacctaccaatgatatcacctattaatctaggggtatatatacgtttctatcatcataattagcacaatatttctccttttgtttccctcaaaccctcctcacaagacatatatccctccttatcctcgaaattccacagcggatttagctcagatgggagagcgccagactgaagtctctcttcggtcctgaaatctggaggtcctgtgttcgatccacagaattcgcagtctttttgccactgctgttattcttttttgctctttttgcaacttctcctgaacagtttcagatgtggtaggttcctttacttgtagttttggggtgtgtggtgaagtgaggtgttgaagtgaggtggtgaagtgtttgttagtctcaagatatatatgttgaaaccatttctgtattatattctgtggtagtagcgctttagcatcaactgacactcccatccgatgtcctagaagtgagccaaagagatacttgtaccttacctgaactagaatgaatcattggatatacagccgcccaaggatgccgtacgataccatctaatcacctcattgtctttctcacttcccgtttcccatctccatagacagtcaaacttcttcagatctgggtagtaggacaatgccaacagagcctttcaaaactgggttctaagaagcagatacatctgtctcaatgtcgataattctggtgtattccgcctccctgtacatatattctggagatcgattcagggacagttgagtcgggccttcaggtatcctggaggaaagaaacaaacgaaagatcagataaatccgccactgtgaaccaccaaagccgatgtttcggaaaagtatgagcagtggacctgcttgtcggagatgttgatgtactgtactataccaagggatatcgttggagcagaagccgttgttctagccccaagaaagcagaagaccacgttatcgggcttggtgggcatgtaaaactggttgatggacacctctccagcagtaggaggagacgagggttgaagagataaatgcagcgttacgaactcggggtttccagaagtgaaaaaattaactacaagagtcttgttcgttgaccgtagtgaagagtaacagcaagtgtcccgtgacaacagcgtacaggtacaatattgacattaaatggttataaagaccggcataataaagagggctgttatatgagcttttttttatttacaatctgtgaaataaatcgaatctcctgggtcctacaaaccagggagacaaaatctggtctttcggagattagcggagattagcggagttaggggaatataatcagataatttgtgtagatggtgtagagactttcgtgaatttgagaccaagacgcgcaatgaaattgcttttttaaacagattggtaatttcagcaatgaacggtactttggttcttctccgatataccatctacaacacttagtctaattgtgccactctatccaccaacttgtcattataacaacctgtgctgtgtgttttacacttgctcgatatcatctaacgtctcgtgtcaactccactggacatgtccctcagcaaagaactggctcaaagatccctcgctcgatcagactacatctacggcaccaccctccatccccatgaatacgagcggtatctacacgagttgtattacgccctgacccatcatcccactgctcttaccacgagattggcccctaaccagctgctccagatgttcttcaactcgtttaggatcaccatggacagaaacatccgggtcatgagaacgttcttcatcgatatcttcccctcgcccttcattcaatacagtatccacgacatggtaagggcggtaggatgggctgtggaatcgttccggaaagatcccagaacccatctacacgctctccaagtcatccagtaccacgaggcagatctggcttcactcatcggcgtgcgccctgtgctgtatccggtacccgaacgaagtccggaagttgtgtatcaaccggaggaacagggagttgacattttggtgggaaatccatcggaggagtatttggatcacctgcttcagaacgacggagacgttcaggagttggagattctacttagatgtgccagcttggacagttaacagtgtgaaatgatggtgtgtacagtgaatgagatgagaacgacgggggacgtagtaaaaagctactcattccaaaactaagtgagtagggtgtgtttccagacaaaaaaatcactgatcagctagaagctatgggaatcaaacccacatatgttcctccactgtcagttctcgtagaacatgacatggacaggaattgaacctgcaacccttcgattacaaccaagttgactggagtcgaaagctctaccattgagccaccacatcagtgatatgtttgcaacgagaattctggcctccaatggatgagatctgcttagtcaggaccagctgaatatcacgtgaaatgcaaattgagtgctggatccgattttctgacccttgcagtccccactaaaaaaatattttgttgaaatcacaacgagaatactcatttggatttcgatttttcgcgaagaaaattcacaagtttcggaaattctagttccaaagatgttgcaaaacataactcctggtttcttggtctagttggtcatggcatctgcttaacacgcagaacgtcggcagttcgatcctgccagaaatcactttttgtcaagcagatgttgttattgtttttcctaggcgttttctgtctttttgtcatatctttggttggtgacagaatctccgattacgccatttccaccctctagcagtcacgtccaccctctagcagccacataaccaccctcaagcagtccaacttgggtgtataaaacgactttctgaccatgttcacagtcgcgaactccaatttggcactttcaaaaacagtttacacaagttggacgtcttccagttctgatggcgtttttccgctagtctacagttgtcatggtggatgagatctcgggattatgttaaaggtttgaacaatggcccttttcgccataattggcatttttttcaaaccaaaaaaccactttcagatgttagtacaattgatataatcccaggatacaaccccttcctcgtcaatagagcaatatattttatatattttttatatattttttatatttttcttatcaaaatgaaaaattaaggtttctacaaaaactcacctgcataatcgggaagattcaagtcgtgataagtagttatgctcagaccccaaaatcagccctaattgttacagaatgttccttcccgaacagtcataagcaccttctctcaaacttcaaacacgtcatcattcaacgcctcttgcagttcagtcacgtgtcactcacagaaccgctcacgaatggaaagaaccaacaaagagcctggattggaggtgccgaaagagtcgatggtgtgctcagtaagacatttgtgatgcgataagacgaaatcaacgaatttgcagctgagtgtgagtttgcttttgaattgatatgatcacgcaaagtgaaagatcacagcgagagagcgatgcgatgctgttgggaaccgccgcccataccgagtcgattttcatgtttaccctatgtctaatcactttcaccacccggacctcggcagaacagagctacgaatctacaacatacctcacaaccacaaaaccgacctctccaatcttacccctggaatatctgctttgattgaacagactcgacgggaccagcacgggcgagtacccacagaaggctaccatgttcccccgagccgtcagactcgacgcttggaggtcagacggctcaactctcagcgcagcggacagggggtttcaattcaggcaaccttttttaaatggaagaaggagaataagacctagcaaagtgatgacggggtctcggcatgagaggtggaattgcatttggaaggacagcaatggtaagccctgaaagtctatgtgatgggctcctcgttttcagagactgtttggaggacctccgataatcaacggtgagacaagtaggatcatgatcacaagttttttacagatcctgatttcgatgaaccgttttcacttgtgcaactggccagagatgcagggtaacctgatgaagaaatggatgctattgacaaggcatgtggatgacagagcttctgcaccgcaccttctacctcgattggagacattcagctcggttgacttattggaaaagtatttacagaacttttcaaacacctacaagagccctgaaggcggtgggaactcttacttcgcttgggttagaactttccacaagacgttcacatcaacaactgatccacgacaaccacccagcggatcgagttctcatgccacaagtacgaggaagcatggaatacaaaaatggcatcgtagaggaatgtcctgtgcgtgtggtagctataagaacgaggagaacaagtgccacttgtgccacctccaatccacttatctccttttatcagacggttacaatcacgattcagaaggggcggcttgcattcgatatccgcgtcagacataaaagagagcatgaggatctgacaagatactaagagacccctgttggtgattgatgagggttttgatattagaagaatgcgggcttgtaataatgagcctgattcaacttacacattgatttgtgtgaagaatagatctctggtcgcatggtcgagaccgcaaccagtttgaacaatcctgttggagatgatgaaatccttaggaaggacgaacattattaaggagttgcaagtgatttataagcctataatggaactgggctgtacgttctactctaataggatgaacaatcgtggccttttacgacatcaaaattgtttgtgcactgagagaatcgaaccaatatgcagtgaatgcctcagtcgaggaactattcatcctttgcacctaactggagatctatcggctgttgaatttgatagccatcgaagtatacgaatcggtacaatacgactattgtcaactgtaacagtcagctattccagctcatctgtcaggcacctccttgaccccttacccaactccattgcactattcagaggaaacttgaaatttggacatggaggacgagcaagtcagagtctcagagttctgaagagcaccatgagatacaaaagattgtagatcatcatgaaatgtggttggcagagtgttcataggactgctcacggtactctctagctacagtatatacttccaagtacacagtgaagatacagtacaaataacttgactagccatcaataatgaagggtgtctattaggagtttgaaaaagagtcgttaattgaatgaggctctcatgtatgttactgtggttgggctccgcggtgtgctcaccatgaagaatgagcttggagtagtaccttgtacatagtgtctgttggccgagaatgtactctggttgttgtcacaaagaatacttttgatgtccgtagacctggatattggaaccagggtgaactccgtatgtcctttcagacgcctgctacctctatacaggtgttgcataccgtccatactgcactttccatctcgtcagctacgatcaagcagtcccgtatgtttggcagaaaagaataattcccagtatcaagtcaattgtaataactccagtttcctgtttactcgaagagaatctctttcccttgaatctcgacaccattgaaccaccacaatccatcctgagcctcaggcatcagacctgaaaagatcttcgaccatatctcgaccaccacaagtcaggatagcacatattatctgaatctgtacacgacgcagaacatccgtgcatgggctattttggttgcaccgctttttttttttttattctaatgattcattacagctatatacctagtaagccgggttattggtcgccagtattaccagtcaaaccaaccgaagtccgggcctgtgttctaacaagtcacatccgcggttgtatagtgtagcggttatcaccttggattctgaagcattcttcgatttccagtaaccccggttcgattccgggtacgaccttcttttttatccctcccattgagggactaattatggcgttcacgtccagtatttttgcactgtgctttacctttgctgtcgttcgatttatgttgttcctatgtagcgctatttaaatttcgatatagttatttacttatatttgttaatttttcagaaaatataaatgtcacggagcagacatatagaatgtatatgcagaaaaaaaaaaaaaatacagagaaacgcttccaaaagccaaggaatgtgatacaaaagcgtgaaaagccagaatctatgagaaggaccaaaattataattacagcaccctggattctcgtaacttcttgaaaccagtaggatgttcctcagaacggggtgtctcctggaaagatgatacaacctttcaggactctgctaggcaatatttggtggggagaggggatccaagtcttcctgagggaagatgtggccgtggtgtcagaaagcgcattgggggtgtttcggcttggggtgggaggaagacactagcaccaccgtgggacctcgtaatctgtggtcgggaagaagtagaaacaatcgttaagagaagccgtgcgtactacttcttaagaacccgagcgaaggactggcatatccgtagaccaggaagagggactcatcgtccttgttaactgaattgcttcttctccagtctcatccaagggcgtggcactcgagatacggctcgataatttcgcctgggaccagcctttctcaccttgtctacaatgaaaaaggcgagttgagagaagttgaaggaccccaaggagccagtcctcggactgccgctcgtcatggaccttcttaatcttccgaatatctccagaggcacgggcgacaggagattcgccattaggtagagggctgacacagctggaaagagaccacctctctctgtggaaagaatagtctcgtggttgcgaacataaggatactttaccgtcttgtctctcgccataacaacacgaacagatggaagtttttagtctcattcttgcgaaaaagacgagagcacataggacggagccccagggtgtctatctttcctggtatcaagaccccatcaccagtactcaaagacgtctttttcagctgtagggtcggcggtggagagtaaatcacgttcatcataattgggattataatattatcgctacttcttctacactagtgatccattcatcgagaatttcggcctcagatgaaaaacaagttgcaattttttacacttcagcctccactgttggtgtttcaatgctactgttgtcatgggtttggtcttagcagggcagccctgccctgttgcgaagaacgcgcataaaaaattaatgaaaaatccacatagagcccacaccgcaataatctgtcacccctcacacaaagtgtgttttgttcattgtaagagccgttaccgcaaaagagccgaaaaaaaaaaagcacttgagggcacccgagacttacttgcatcactggaaagaagcgtcagaccttgaccacgtgaggctccggagagtggattccagtttccggtggtcttgcaaaatccaccgcctcaagcattcttctgagaacgaatatgagacactagagggacggggattcccttcctaatccagtctctcgacgtttcgcactattcaaaagctgagacgactctgatccgggtaaactccaaggaacggaccacgaggctgctctataggaaatgggaggaactttccaccaccccaacactgcgtcatttcctgtccagccctggctatgtaatcaccttactgagtgggtcctctaccggcacgatgtgccaagtggaggggaccaaggctaccttcagcagtactgtgcacccgagagcgagacttcatccaggtgctggttgaaatcgtggtggatatcgaagacattgcacgtgagtctgaagacccagacagagtgctttgtaccactttgcggtgtctggctatcacacagacggtgcttgagcaggtggagacgtctctggagtcgaatgtcgagctgagcggtctactagattctttggttcttccctcagttcgctctcatgtgattacaatccgtgaacggggtctacgatgcctgggtcttctttctctgttatctcgtgaacaagcgtcggacaatctcatggttttcggacactgtgttcacaagggcgaggctgagttcaaggttgaagctcttaagatcatgtctgatattttggttcttcatggtcgttcagttctcgatcttcccgataaagtggactctgagagtgtgttcaatggcgtccatggaaaaaaagcaaatgtctctttgattgcttacatgaagtgacacagactcaaggagctagcagtactgaaaactcacagaaatgcccacctgaaatgaatggagaggagaaagtcgatgccgtttcatccgggtcgtagaagatgtgtcataatgatgtcgtaatggtgtcgtaaaggtttgtgaatgatatagtcgataatgccgtaaagtgagaagagaagaggaacaagaattggaggctacaaacattttcaagataagctaaggtgacacagattctgttgtcatcccaagtacagtttttaatgttggtacttttcaccttaatttttatattttgttagtagttttactgtaataggaagaaaacatataagatatatacgatgtacattcccaggatatatttacttatcctatatattgtttgtgttgtattgtacagtttaggtctgggttatcaatacataaggttgagataatgcaagagcgtgcataatcgagacactgtttaggtacaagtcggcgatgagctgttggtaaattctattctcttggtcgcgaattactgggtataatggttactaaaatatctttctaaccattcagattttctcaaatctttgcaaatctttcctcttacctaaaattcaatgatttggttcagaatctcaggacgcggaatgatgatgttatctgctcaccgagcttgggcctttaagtcaatcagcagagccagctactcctgtcgggagacatttagtcgatagctcgctccagcttggaacgagggcaaggtcgacttcttgtagggtgctcagggggatcgatttggaagaccacggtagcagggtgttgaggactgtagacagaagttacctttcaaacccacgtaagattagctgaaaagacagtcgatccacatgccaaagaaagtcccacggaaaactattgccaaaacgattccaaacacccaccttggctcgtctgcccgcctccccgaggctccttcagaggacgaggcccactcacaatctggcttatagcaccttagcagtacatcacatacccccgagatctgcccaacgatcagtactatcgctgatggtatataggagaaaggataacaggtgattttaggggaccacgatcctatctgaactacactgacgtgaaaacccatggagacctcatcgccggctatctgaggacccaccataatcgactgtgagcccaccgaagaaagctgaaggaggattggagagtggattaaattatcgttaagttggcgggatgggtcagttgatgctgagtggctttcacaaccccttgtcaattgtgatagcgtagtaatgagggcggccagatcacagacaagaaaagtttattgaaaaaatattttgtaagaatactggataaattatatgtatggattatgttataataaaagtaatgggaatatattcttttaccaactagactcagccagacatggatacacttaagactaccactacagaatggatagagtgctagtaggtatcccatttgatgccgaactaacattcggcctcacatgcagcctcactcaaactcactcagtctcacatccaacctcacattgatattaccggattgagaaaccatagcacctcgataatccttctagatgcgacagccccaataatttgccttgtccgctatagcgacatgactagcggttcataggggcttgcacgagagatgcaagtttggtttcggaatatgaaggtgtagagaagaggtcaggagactgcttgagcctcgagaagtatttaatatgctggtttgatgcttcataatgacttctacacttccttaaacaccgccacttgtcatagaccaagaacagcttcacacagccatcttttcactaccaccttttcacaaccaccttttcacagccacctctacaaaatcacatacaatgttttgcgcaggcgtaatttccaagttgccgagattcttcattctggtatttctcgtgatcaacatctttctagccaccttcatcttcatgggttgtatcaacaagtctgcgtcattctccaacgtctatcttgttgaatactcctacaaccaggactcggtgttttttgacgccatcaagagctccttcaagcagtccaatgcaaccgacctggcttacttgaaagctcggtctggcttcttcggtgcatgtgccactgttagcaacgctaccgagtgtgtctctagaggcaacctgactgccctcgaagacatgttccccagtctgagtatcactcagtctggtaccaactcctctgccctagggcttattcagctggctacccagttcacaggggacattgttcatcctagcctcccagtcgtcactctggtgctcgacgttctggtttttgtctttgtcctctggagcattttcgcctttattcctggagccactcaagccggtatcatgatgatgtggacctctatctgcgcttttctcacctggagtgtctgtaccatttggttccatgtctccacgctcgtgggcacaatcttcattgagagctcgagtgctggagccgtcacctctgccgttggaggacgtatcaagggtatgatctggaccacctttaccttccagttgcttatcggtctgttggcagtatggactacacacaagtcgtcgattcagaaagccaagaaagaggccgactacgaagcgcgtgcgtatgccgtcaaggcttgaacaaaagtggtacctctcaagacattatatactgtataaataactcaaaaagtggtttagaggctagtttttcgtaattaccatacagtacgttcatgtattactcgtagttcatgatgccattatcactgttccatctcaaaattactgtacagtacatactgtccttcaggcacatgattggagccattgcagaaatacaccacagagaactcgaccaaaaacacagaaaaaggaacctattcaacgaaagtaaaaagaatagcggtacctggtttcgatccagggacatcagggttatgagccctgcgcgcttccgctgcgccataccgcttgtagagataccttgtggagagggcatgagagatacgcactggcttttatcatctagaagttgcccaattttggcaatatgagagccggtacttgaatgttatatttaattggatacagacggtgtttttaaggcaacttttgagctctggtcgcaagtttggtcaagtcgtgtcgtttacgggagacaatgtgggtgtatattgtacgagtgtaagtatatggaatctggcaaattgagagatctatctatcgtggaaatatctcaaagaagacctcgtcaactcaaccctgtctatgggaggtttattacttgtacttgtacaactatttaattaactactatactgtacagtatgtagtgctctcttcaaaaatagtacaatctatcgtgttctacaaatcagaacgtcgttggagtagaatagtggcgaaacaaccgcaataagcacaattggaatggtcaaacttgaaattctgtcaagaatctctctcagaagaggatctatatgcaagtatatagatactgtcctcaatcctgaactactgtttatactgtagtcgtccagaccatgtagcgacaaaacgggaaagcgtggaacaatatatatattaaccagcaatgaactccccaatggtagagtcaaagatgaaatattgagaagagaaggggttttcaattagatcctcacggtatggaaaactttagacccagagaaaatacaccacaaagtcgatagtgagacttggcaaaacataccaaacatgtcaatattcaccatgtcatcaatttccaccccttgtagtgttcctttcgcttttcccgcgtttttcgcctcattttcagcacaagtgcatcatctaccatccttggtctcacagcggatttagctcagatgggagagcgccagactgaagtaatatctcagtcaagtaatctggaggtcctgtgttcgatccacagaattcgcaatgctacagcttgtctgtaggtatcttttttgtgatacattttgcttttacttcatgtttcccaccgtcgtcattgcagcgtgtgtacggtacatactgtgggtggtaggggcgttgcgattagtcaattgatgtatactttttcggatgcttgagatcctaggacgtatctcatggaaaaggcgtctgtcgagaataatctcaaatgttgtggtgtaatggtggtgtatggagcatcagggggttggaaatgcaaaaggcatatatctccagggatgtatgagacatagctctgcccggaaatgtttgtgaattgcgcatagaaccaatgttcctgtagaagacgcatctgcgatagttccaatgttccagaagcaagacacatctgcgattgttcaattcaagatcttctgcccgcactctactgcatgaaattgtacagcagtcgctcgaatctgacaggcagcttgttgctcttctcgactccttcactcagccacactccagtgcctccaatctggttagccatcaccacatctgtcaacagacgatctcccaccactgccacttcggatggctgatcaatgaccttgttctttttcaggtatgctaccaggtcctcgtggcaccccggctttttgaccgcgtgtctgtacacctcgagtccggtgttttgctccactcgttgggcgtccttgaagtctgtgtcgtcattggtaccggcggagttggacacaaccagcagctgcagtttgcccgggtactgctttttgagctcgtccatcttgtcatgatactgttcaaacacgtgatctgcgccgtccaccgcaaagcagttgtctttatcgagaatgactgccttgatctgggcgccgtttttgccgggaataggtaccggcagctggctgaagttgctgacggtcacgtggggcttgatcagcgacgggttgaacagcagtttgaacgtgttgagcgttgccgagagattcaggccgttcaccattgtgtttgttgaagggttgtggatgttgaagtcgaactttgatctgaaaaaataaaataataataaaaataatgataagaataataataataaaaataataaataaaaacaaaaacagaagacaatcatccgaggaggtagatgggtaattaacggtgaattgacaattttaataagaaacagaagactcgtatttatcgtaaaaaataccaaaaaaatcgtcacggacaggattcgaacctgcgcgggcaaaacccactgcctaacagctaacaaattagcagggcaacgccttaaccactcggccaccgggacgcggtcgaacggaaggaggtccgaggagtctatattcggtagaaattatgactaatcagtaacgacagaatgactttgagagacagatttcagaggatgaaacggagggtatagttgaatgaaacaaaggaatagttgtacgaatctgaaagtatagttgactcaataatatggcatgaatgtgactgtcttttatcatggtggtaggtgtgaaaccaactgtcagcattaacaatgtggaatcctctacattgtctgttggatattgtacggtgttccaagtactatataatatcttttaatgaagtcatattacacacttgtccccatatcaccacatttgcctcataaaactactgctactagtattcacgtagagataccagtcagtcaatctatgcacatcttctggataccagatcagctactttatgttgcgattaatttcattacaacatgaaagaagctagtatatggtccgagataggcagtgcgatatgaattcatactgttcttaccacagagcctttttatgcgtacagtagcaagccagtacaaggtgaatgagaaggagtggagtgcgagaactacagctctcgggagtatataaacacggactgatgtctggtggagtctacccaacaaacaaccaccaccagtttatctcgtgattcgccatgctgttcaagaaccttgcccttatctctcttgtcacccttgttgctgccaaccaggctgttcctgtcgacaactctgctccggctgtggctgagtctcccgaggacatttccaagctcaagccccagtgtcccgagcaaaagtgtcccaagcccaaggttcacaagctgaccaagaacatcaccaagaccgtgatgaagaccgtcaccaagtctgccaacaagtgtcagcccactcattaagtgccgacgtacgattttgatcgatccagaagtagtaaatcgattcagaagtagttaatcgatccagaagtagttcgtcaagtcatcctgaacgggatgtttctgttccatgttgaatggtaccttctggtggcttgatcgtgactggggcgtaatagcatccaacaagtcaagcaacaactgtagtgtgcttaaaaggaagatcttccttgtcaccaggatctgccgagctcaacaatacactccccacggaggtcaacatctgaatagtcgattcatcatacgagccccgtattgctcaagaagccacaaacgggaatagtggacatgaacgggagatgatcggcagccctgaagatcgtttaatacgaacacttgtctcaaatcttcccctttaccttcaaaataagcgtcttctgaacacttgatggaatcgtcctagatggtaggagaaacacaacgaagttctgaggacactcccgttcgactcgccaggccgcaatcatcaaaatagcgccaattgtcgccattccaacacccttgccaagtccatattctccaaaagtggctgctattgcgactcatgcggagaaagacgtgctttatctaggcgcagaatctagtgatgcgcgtcgcgctagtgttagcgccacactaacgagatgggtacgagacgagacggggttcccacgcggttatttgctcttttgctaggaacacacgtctctagcagcgatcagaaccctcaggagtgtgaattggttggtggaaggcggaagattcagttgcaaaggcggtgttcgtacaattacagggctctacaatggcgcaagttcatgctagtcgtctgttgtcttctttagcgtcatctgtcaatccaagccacagcttagtacgactcgtacaaggactactctgcagtacgagtaggggtttggtgataggagtagcggtagtgtgcgagtgtgagtatgggtatgtctgtattgatcttttccggactgatttgaccctgttgatggatctgcgaagaatgaacgggttcttatctccatcatcagtaatggggtgttattgacagccagtccaagtacagtaagtgcagttgaggccacaaaagtgtcctcatagtatcaagagagttgaaccgccattagcagcaagtctcacaatccctgctcacccattcgagacagtccaacagtggacgttagggtcggactggcgttggacaagggtgtgagagaccaatatttgagagactttgagcccataaaaaccacatcatcagaaagagaaggtttcagcgatcaaattgatatcaaaatcatccagtaatttgttgttaaaatgacatatttttccctgaaatattttagcagaaaaaaaaaataaaaaaaaaaaaggatgagaacaatttaagttggatctgaaaagacagacacttcaatatcacaactgcgaaatggtgaaaatgcgttgattgaaaaaaggaaaaaaagaagggaaaaaaccaggggaaaaaacggccaatctcggagttctccgcacaatcacttcaacaaacgctcgcgcccaagccgaatacccgcactgcgcctgtcagtcacgcgccagacaggtgtcaaaccagcatgaaaagtttatgaagcgcctatttttaagcaagggctttgacaggttcgaggacggtccggagaagcccgtggaacgtgtctgtggcgtttttgagatgtcctagatgcatacgcatataaagcgatttgatctggtggttgtccgacaatcaccgaaccctccatgtcaatcaagtcgctctcaaagggctcctcgctggatgacacttgtgtcggcatctcccgggtggctaccccgaccaacctcgagaaagacctgtcattatgggagacgatgaagatctacaagaaggcgacattctggagctttgtcatgtgctgcaccatcatcatggacggctacgatggaaacatggtgccgtctttctacgcgcttcccgtgttccagaaaaagttcggcatccagctccccaacggagactggacagtggaagccaagtggcagacggcgtttctggtgggagtccccattggcagaatcacaggtgccgtgggagtcggtctgctggcagacagattcggcagaaagaaggtgactatcacgtctctggcattcatggtgggagtgacctttgttgtgttttttgccaccggcaaggaaatgctgtgtgccggctggatcatcagtggaattatctggggcgttttcaacaccatggccccgacctacgtctcggaagtgtgccccatcaaaatgcggagtcttttggcagccgctatcaacctgtcctgggtcgccggacagttcatttccaccggagtcgtcacaggtacgtccaccagaaccgacgactgggcatatcgagtaccgctagcagtgcaatgggtgtttccggcaattctgattcccacattgtgctttgccccagagtctccgtggtggctcttgcgacggggagagattgacaaggcaagaaacgcactggctagactggcagacgagaccaaaattgacctcgacgcgcatctcgaacacatgatccagaccgacaaggaggaagacaagtcaggaacgatagccgagtgcttcaagggtccagatctccatcgtaccgaaatctgctccatggtgtactccatccagccgctgtcaggagccaacattattaacttcttcgccttcttcttccaactgacaggagtgccccaagacattatcttcaaactcaccctgggacttacaggtttggggtttttggctactctgctgtcgtctgttcccatcgctcgagtgggaagacgcaaaatcatgctcacgggactgtttgttctgacggtggctctttttgccatgggtattctgggctgttttacatcccggggaaccaactgggctaccgcaatcttgctatttgtgtgggtcggcacgtacgacctgtccattggtcctggagcttttgtgatttactcagagtcgtcgtctgtgcgtctgagatccaaaaccatcgccattgcctccgtcatttcctcgacagtgactcttgttttcaacgtggctgttccatacatgttgaacgaggctgaggccaacatgcgaggacttgtggggtttgtgtatggtccgctgtgtatactgtctctgatctgggtctattttcgtcttccggagctcaaggggctcagttatatggagattgatcggttgtttgagggcaagaaggttgctaaagatggtgtctaggaatagagtgattgacgaggaatggatatggttgcttagttcaggttgtagaagaagtatggtggtgtcgtgagcagtcagggttagtggcttctatcaaaatccgatgaaaccgactaatgtctttgttctcaagccagcagaaaaatctaatcaaagttgcgataatgcacgatcgttatctcaactttatccgcaccgatacgataggggtacatcgagtctgtaaccaacaaaaaatcatctacggcaggtctacaactcacttgcgacaaccacggacttgttcatcctgctccatgacaaaagcggcctctgaaatgagttcttggattgtgctgtgtatacggatcttgccactcattgtggaccaagccaggactgaatcggaatcagctcgaacctccgcattgtcatcgttgccctcgggtttttatgtctctgttcaccctccgctgtagtgttactgtatgtttgttcgttttttcagcatctatgtacaaaatacattcacggttgaaattccgatcttaaccgtgggctgctattactgtcttggatatatttcagcttctaaacggttgccgttttcttccaagtccagacggcagagatttgctgacacagctaattgatcctggaagagaatcattcctcgctatccatgattcacacccaactccagtacaataccagttacctgggtttttctttatgtatgtatgtatgtactgtacatactgtaggagtacatactagcacgataaatttctgtacagtactagcacaatatataattctcgtactatactacaagtagcacgatatataattctcgtatttagcacgatgtataaatctcatactaacacgaatataattctcgtaaagcacaaatataatactcgtacggtactctcccagtacaattgccatcactaatctctcccgattctcactgagctatttctccgggaaatattggttttggtacaacaacaccaccgtcctcaaaaatgcggcaatttgaaaatttatttgaacaagctctcaatattgccattttcgataatgtcttacagtttttgcaatctcgacacgcgagtggacagacatacagtggatctaggtaaagggctcatcaggttttattttgtgaactaaaagtgtatcgcttggtgaaatgattcaaatatcctgatgaataattcaaataccctgatgaataaatcacatctccggaagaaaatctcatttattcttcacacagattgatttattcacgtgttcttcccattttttacattttaatggccgaaatgaatgagaccacgactcaaaatgtgcggtgttctgcctaaattgacccgtttgacatatttttacacatttagacacattattggattcctctcaaacagaagaatcgaatggtaaactccatttttcaatcgaatcactcacggtgtcttggagtgtggatgcaactatcatacaatgtactgtatagtacttacttggggtgaatgggtgagagccagtaggtatcccctggtctaaatgcaatcaccacattccaacacaccattgtttctgaatgtacacaaatttgcggatcatgtgattccaaaaaggtattcctgccgtttcaggtcttctactcaggcaggttgggatttccttgctggaaagcctcttccttcttcttagtgcagggagcatgacccaggacttgtgaaggatccttagtaagcaggtagttctcgtgtgtagtgtacctactgtcttcattctattcgttagttctcagcttttaaatatatcctgaacaattcattgaatcaactatagtcctatctcacctgactttgagatgtgtcttgtgtagctgtagtttgacttgatgtcgcccttgtagctaggaactgtcatatcattgagctatgtcacggcaggtagctgaaccacatcacagcggtcctcttttccaagtgcacaccctcaatagtccacagcaatagcccgtcttgccaacaatcaactaagcctagggctggtatgctacagcttagcaacctcctcaacatactctccaaaaacgctgtctccctttctctctctcaaaacccgtcgcagaatcttgcccgaggcagacttggggatagcatcaaccaccacaatgcctccgtaaagacgcttgtacgagggaactcgacggtcaaaccactgcttaatcaccgggagagctcgcgcttcagtaacaagaaacgcccgagcagactccgtgcctcggtcgggattggtgactccaatgacagcgacatcctttaccatgggatggcccagcagcacagattcaatctcagccggagccacctgacgtccgttgaccttgatcatctccttgtttcggtccacaatggtgagtcgtccttccaggtccatgtatcctatatcgccggtcttgagccactcgccgtcaaacgactcagagttggccgagtcgttgttgaagtaacccggagtcacgtggggaccgcggatgtagatttcgccggttggaggagtcacaaacgaccatttggaacgcggaacatcgcccttttcgcccacaattcgcacctcggtgttgggaagcagttttcccacggtcttgagatcgcgttcgggatcttcgggcttgaaaacagacacctggagagtctctgtgagtccgtagccctggatgagaaccaagggatccattccgttgtctctgttgccctctttgttgcccgtaagacgctccagaagcgcgtctcctgcagtagggggaaggggagccgctccagtggcgatcagagtggtgagttcgcaaatggacttaatgtagggctgtacacggctgtccttagccagagccaacaccactggagggaccagatacagaatgttgattttgtacttgatctgggcctccagcaggtccaccagggagaacttggggaacacaacggtggtcattgagcctgcgaccgagtggaaaacaaacttggtgagtccgtagacgtgagtcatgggcacaattgcggcggtcacgttttttcgggcgctgaatatggtctgggaggagatgacggcttcggtggaagacgacatgttgatgtgggtctgttggaccgccttggggagtccactggtgccactggacatgcccaggtaggcgacccggttggggttggaggtagtgaactttttccagggggcagacgactgggttttgagcagatcttcaatgaagatgagcttggtgttgctggaggcgcttttgaccttgggttcgaactgctggttgcagatgaccagcgacgggctgcagaccttgatttggtgcgcgagatcgcccgcctcgtaggtggcagctgcgggggtgattgttacgcccagatccagtaaagcgtagtggacagacgccagtagcggcgaattgactgcatgtagcatgacgacagggcccacattctcgtctggtttggcgtcggtgagtccgtagtcgttgtacagggcggagctgagtcggtcggccagtttccagacctcggagtagctgattgagttgcctgtgaccacgtcaatgtaggctggatctgtcgacgagtaggacggttttgttcgcaggtaatcggtcacggttccgttgaaaatcggcagagttccggtgctgtggatgatcatgttttggttgtttttggttggtttggttgattgtgtttgtgtttgtgtttctcaattggccgcaacttgtacaagtacttgtagtcaatcgtcaatcgtcaatcgtccatcgtcaaggcctgatatataaactcacgataaggtggggatatgcacgatcggccgaactgacttttgtggggtgcaggcaactggacaagagcagaagtcatccaagacgccacgtgaaagtgggggaatcggggagaattggggataatgacgagaagcggcgttggtatcggtgattagtcagctttctggcggcagcggcttgtctgtgcgtgtatggaggcgttttggggtggttctgaagatcctctcggtaatcataaaatcaccaactcagtatgatgcagctacagtacttgtagtacagttcagtagatggatgtagtggcactatggagaaccttgacgttgtggcaaaccactagtttccgttccgagggacgtctgagggaatcccgagggacaaaattccgagggacgaattctccacagggcgtgcagagtcctgaagagtctgacagagaagagtttggttatctacacgctccctgtaagaggggatcaaagtcgttaagttcagattcgttcagtcttgtcactagtctctttgacagctggaggggaagaccgcacgtgcagagtgattattcggaggtgcagagagagagagagaaagagagagagagagagagagagagagagagagaatgagaagggtatgggacacggaggttcgggatcgtggtcgtggtcgtggtcacaatgagaagtccagacgctttcaaaactatcccccacctccagactcattgtgctcgattgagtcagtgaagtcatctcaaaggtgaaaaacatcgtctagagaatgactcttgagaatggatgactggcgacgggttaatttcgacatacccaccgtctctttactgtcgaaatgtgaatggtgttctgggtggttcattaccgtcaagtccattgaacttggaggtttgacagtcgaaaagaaataaaagaaccatgatactgtccagtgtcgaattgaaggatatctaataaaagaaaccaagtggtcaaggggtggttgataccacctacatgtttctctccgttacagtgtatgatactcaaaaggacccacttgagatgctcgagactttctggttccagtttccgattgtgacttggagactacgtgaatgttcattcccctgaactgaagatctctctaaagtacattcccctgaactgaagatctttctgaagtacttctactgtactgcaaacaaccacagcagtattcgcagatcaacgaatcataaagagactgctgaagggcattctatcgtcatgtcagagttcaattaccgatacaaacaactgaccaattcccaacatatttcttcactaatattgaacatttgtcgacctcacttcgtggccaactctccaaaaatattgccactaatacaatacataactggtgatgtttgttgacccccttcatgttcatcaccagtcgaagaacacagtatctcttccagaaaatccagatccacactaaaagggtggctggcactcgactacctgcctcaaatacctgcctcaactccatcccggaagctgtagaataatcccattgactgatgtcaacttcatccaactatcaccaaactcggcaagaaacatctacgagaacactcgaatcagcctctgaaggcccgggtggtcacgtgactactggtagcatttagtcacatgaccaataactaactgcagtagccacgtgaccccgtcaccatcacatgatcacgcctccatctccacctcccatccatcacgtaatcagctaataatgcggggtatttttcactttataaatattttattttttcactaaactcaaaaaagactctaagtcagcctcacccctcaaggttcgctatctcgcatgtctccacactaccgccaatgaacagtctgcccagcgagatcgtgcatctggtggttggccactgtccgctggaggcgtgcgtcgcgctcggcgacacaaacacgcgcttcagaggcctgacagatccgtttttgggcgaaaaagtgcggaaacgatgcccttttatgctcccgagaacagggacaccgacaatgttgcaagagccacagaaggaaccgacacaaacagaaaagcaacagaaacccacagaatcatggcgactatgtgctcgacttgttcttgctcgacagaaacagcatctgatcactctgtctgaagagcatcaagatcctctagtctattcactcaaagtcggcatgaagaccctcaactacgtgctcaagacagatctcgaagcgtgtcaaggcttaatagacacaaacaaccacgtcgagggcgaagaagatatgaaaaagttgtgccgtgagattctggaccatcatcaagactcccccgtcaccgtctccagacccaatctgagtcatgtcaccttccctgaacaaggagtccacaacttcattcaccatccccatcccgacttcaccttcttcagtatgctacagcccaagggatggttcctctactgtgccatcgacaagaacccccttcttccaatctttggaccctttgctttctctcatccagacagttttcgcgtgttcgtatacgacggagtggtatgggtggactttgatggagcagtgttgccatttgttgttgacgcagaagacaatacggtacgtttctgcaagcaaaagatgatccatgggtacccagaacagcagggtagggcctttgtccaaggcaagggcgagttatcgcggtacttgtgcaatatgaacggcaaacgcatttgtgatttggaatcgggtgttaactatttccttgaaatgggtaccgatcggttattttactgaccggaagtacagtacagcaagcaccatgaaccatccgaacacttggacaccattttcgacgccgtataacacgttcccaactgttttctcactgctggacaaggtatctccatatccataccctatcttcttcacccctcagcggcaacccccggacacgccttacaactttgaaccaactgaaacgagatttttcacaccgaacacggttccgcttgtttcgagcccatttctcgacttctctctatctttgccaacttacgtcttgtcggtatagcaacagcaagagacaaggggaccatcgggaccaccgaaacggtccagtacaacgctcaatgtcgaagcaagcaatctaaacctctggaagggcttttaaagaggcatttacatcctatgacgacatttccgtcactcaaactcgataacttctaaaaaaaacaccacgtccgaattcaacaacgcaacaaactgcccatgtacctcatcaatagttcaaaaagagtcgatcacttcatcaatgaaagatctatctgtcaggttgtatcattggcccttttctcagccaacgacaacgccatgaatacatgcccagcgcctttcacaccgcatttttcccctgatatactctcacctcggaccatacacttttaagggatcaaatcgactcataaggtgttataggattagtcatcgagtggtctcttactagagaatattatgagacgtcctaaagggcttctgaagaaaatcacatgcctcgcacgtgaccttgaggagttacctggatgttaagggttaccctgtgatgcagaggaacagttatgtaggatgttacgtcatattttaataaatcaagtttatcgccaacaacttccgcagtacaagtggtaccccgtagcagatcagcggtccccgctggtctgagctgaactactgattaaaccggatctggtttctgactacactcatccatggcccgatggtttagtggtataattctcgcttagggtgttcctgagcaatttgcgagaggtcccgggttcaattcccggttgggcccactctttttgctacaactgtcgtcagtctctttctcttgccctcgttgctctcgttgtttgcagttctgtccacggtggggctcgtggttcgcatacagaacgcgtaggagcgatttgctgactgactaagcattgtgggacgtggatatgtcacgtgatgtgtcacgtgatgtgtatgaaaagaattatttcgatttctgttgctgtttcacaacacattttgcaattctgaccccaaggacttctcatgagtctactcttgaacgaaggcgtactatttattagcattttgttaagagtaaagcccactgggggttccttttgggccctgcaaggaatgtggaggtatgatagatgttccagatgttatattgctacatgtttatgaacaaaacatatatttggtggctcagtcatatatatttatgttgtagtttctgttccaggtttgagaggtaagtgcatttagttaaattttttgttaagtttgggaaattttagttaggggttcagttcaggatgcagcgaatgcagtccaagctggtacttaaggacaagatggtactgtattacgatacaaagttcaagaagaataaatatgttagtattcacaagatatggtgatctggtcgaccaatttttgtagtgtacacttcagccgcttccacggttgcgtgagggattcacaagttgcccagtccgttaaaaagattttttggtgtacagtaaagtatgtacagtaacataccgtacagtacagctgaaacgtcaaatcggatctctgaactgggggtaataagtagaagcctggccaccgaaaagttgtgttttatcattcgtaatcctcaccacaggaagatattgctcgagttcctcctctcgactcttcttcatggggtaaaaggtgcgatctattagtttgatggagaatctgagtggttgaacaaagtgctagaagccagcccatgattaagtgcgagtggatttaatggaggagagaggatcagaatgagaagtttgacagaacgaggagtttgacagaacgaggagtttgactgaacgaggagtttgactgaacgaggagtttgactgacccatgtctgaacggcagattgcctcgtgcgaacattagcagattcatagctcagggtagctcagtgttggctcaggaaatgtctggcatagcacccttcattcttctggcaaagcacttttgtatgaattaccgattaataaacgatatcaacacacacgtggtccattggtcggttttctgaggtttggatcccgtatatacgcgataatggagcctgcaaaaacataaacgcgatcagcagtggcaaatgaaacagacactagttgacaactttgtcaaattactgtgtgcgttagtcacacctcaatgtcgagaaaatgtcgatactcattggaaccgccagaaagcccctgttctcacaatcacattcgtgtacttggtctgatcatctgatatcgcaatctccacgtaggagaaatcaaattcggtcctgatttgcactcacacctagttcaaagtaagcaactatcttttgaagttagctctgggtctgggatatttaaaccagcagattcgtccctgttcgtccctgttcgtcacttatctctgaagatggtttacccttactacgccgttgccattggaaaatatgtggggattttcacttcgtctggtgcagccactgcttctacgaccggagtgtcgggtgccagtatgatgggattcaaaactcttggaagcgccatttggtggctggccaccacttctgcagcaggtgctgccacggtgggactgggagttgtcgggctgggagcggctgctctcataatgaccactgattctgatcctgtgccaaagtgtagttggtggcaggtgtggtgttagagtagtgatcggtgaagtgcttggtggagtgattagtggagtgaattgagtgcgttgagtggatcgtgatcgtgtgagttgaatgagtatgttgaatggttgagtacaaatgacgttgttgtaatgattcagtgcgagcagtagtggagaggctatgtcctccctgatgtttggaaatcccgtctgaatacttccgagagcccaaaccatccctagaaattcatcagtagcatgcaattgaccgtgctggctacttcaggacatcggattaatcttctgctactctactgtagtcaccagacaagcttcaactccagctgtgtctaagataagggtcaccctgaaaacgcttgaggttcttggagacatcctcgtattggctctcacaattgtgaaagggccagtatggttttgaatgactagatgagtaagagacggtcgagagcctgctgctcttttggaaaagttctgatcatgaaatgttggtcgtaccaaatgtcgagcagaaagctggtgaagtgagatccaagatgaatgtctttcgatttaatgtgatcccttgagtaggaatctgtacaaaacgaggtgtctgcagaacggcacggtcgctcatagataagacgctcagttggggcccgttcgctgaaaaaacgtttttcaagcataaggattcgtgaggtttccgttcatccatcagatccattctgcttcgggtttagttgccaaagtcggctcaatgacttgtaatttcgacccgatatgtttcttccatcattggtttgattcaagtcgaatttgcacctgtatccatgagagttgttgtacagtattgtactgggcggttgggtatgaaatgttccgatgttgttggaggcagtcagaatcaacatcttgttaccataaggtgaaatctgaccattgtaccccacaatagatgcaatttcagccagttcaaactttcaaacacctcggtgagacttggctgagcttggtggtggcctacacggtgtagacgagatagccgttaccgcaactgttggttttggtacaggggaacacatggaaggaaatccacaacaatattctcatcctgggttgttgaatcagtcggcccaacttcaggtgtcgtagaaatgccagttgtcagtcgagtctagacgatcgcaaaagcacagactcgttgtagttttgaaccacatgtgtaaagccgccttttagatcatagaaccacactaatctttgagccagctgtagagtccaactagagtgaaacttctcatggagacgcatcttgtagacagcttcatctggagtcacggacatctgaactttgatcagctcacatctctctgctggctcgtatcgctctgttggctcacgtcgctctgttgcgtctccccgctcgtccctgctgccactctatacacactcccatcctccacagctctcaccatcaaccccctgctgacatccacaatatatgttcccaaatgagtaggaacaacggcgtagtgataatcccagtgatcatttcgcttgcccagaaacagcagatcgaatatcgatccggagcccgcactgtctgacacagcttctctccccagctggggttgcagcacatggtgaatgccacctcgaaagtagtgaataagtccgtcgtagtacgaaacggactcattgtagccgtcgacttcggccacaatctcaaactcccggtccaccagatagaatagggcccatcccgaaaacagagacggcatcaccagaaacacatggtcgccgaatgttagaatactcggcatttcgaagcatttttcaaacatgtccggctgaagaccttttgagcccttaaacttgatgataatatcgccctcgggccgctcatcgggttcacatactgccatgatcaccagcatatgagggaacgagatcaccttggagtcgtacctgtcctcgggctcgtatccgtactcatttccgtgaaggtcgcggtcttttatcagatcctgcgaacatgtgtttgataaatccacgcggattccgtactcgctggtgtaaacgaggtttgcgattttgcgcttgtcgagccgttcaaaagaggtgtctagaaccggagactcgtggaatttagtagaagaaacagtcttcagtttcggtgttatatccactccgggctttgaacgccgcacctgctcaatcgcacacgctttccacgtgccacgatccgaaaactggggttcgaaccacggacaggagcgtcgtattgctcgctgaaaaagggtatcggaaacgagacgacgccaactcgcactggtttgcgaaagtgcgatgattgactcgagatccagctcttcggcgatcaggagaactatttctggtggcaacatgttgtgtgtagagatgttagtcgcaattaatcatgcataaagtacgcattatcccaaacccttaagttgaagtaatatagttgacgatagttgcgatgttaactatacgacccctcaaccgtgtccagaaaaagaaaagatattggtatctcagaaggtcactggagaaaagaaatgatataaatgattgaattgagagatttttgcggcgtatttcatattttttttcatttctcgatgtcaggaatttgaggtatcccttcccgaagctgtagtaatacttgttagaattctcttcaaatttacttgaggttagttggatgttgtttcgagtcattttcgccacaagtactgaccgtaaaaggaccatttggtcaaaggcttctttttatcatacattgtacacttccagaatctcttcaagctcttttatgagcggaaagtgtactgtacttcctctcacagttaatgcgcacagtgacttaggagtccttggatctttggaaatacgagcgcagtcggtctgtgaagttgacaattgttctcttcagagtacaagtatcgcagcgataccaattttgccctatattaagacattatacagtcatactcacacataaatagttgagagattcggtccatgcaaaagaagccagtatccactgtgatttgtaaattgccatttgaactgacaaaaaaagttcctatcaagtgattacaattgaactacattcttatcgcccccatttatcaactaaaccaccttctttgcgggtttttgcggcaatgaaactcaccttgatgtgaaatcgtctctccccaccaggaaaaatctatatgagcggcatggcgcagcggaagcgcgcagggctcataaccctgatgtccctggatcgaaaccaggtgccgctattcttttttgttgacagaagacgtccttgatcttcagaggtgttggttgtgaatagagactgatacagagtgtgctcttctggacttgtaacatattggtttacaatgaagaacatgaaacggagctgtcgacatgaaacggaggtttccactgctaatctctatgttttcgagcagtatttgggactcttttgactcaattgatgactctacttgtggttcaagtgtctaagccgtccactgtagtctggtaaagtccgagatcacgctagtagcaacagattcaaattgtatattctctttctatcacctgtaaagtaggccaaatcagttccctctccattctgaaatgtattctcacgatctctgctgtctaatcacttccattctacagtagatatcactgaacacatctcccgacccagtcattgcgctcttgtgatgtaggagacttcctcattcaattcaaatcaattcaacggaaaatattcattgaaaactacatcttttaattcgttcttacagtgctctgggcgactctacagtaacagtacataaagtacagcatgtactgcgatcagaaagccatcaatggagttggttactaagggaacttgaatctgaacatctacggcaattcaataatctactatcaattgttttgagtcatatccggtgactctattgaccaaacatgtatcggtcctagaagaacatactgaatatgtaaagcacgcaacttggggcgaccaacaactgttcagagaacattatctggcacagaagtccttcattctatactctccaacttcggaaatctctttccacggccattgagtgcgaattaatcgttgtatgactttttttagagaaactcttcggaactggcccactcagtaaaaccaaaccagtcatcaggtatagttgaagattagttgacaaattgtcatccaagtgcacgtacgaaaaaccacttttcctacagcaccattcaagtctgtatttgcctgatttgatccccatcacttcactcatccttcactcgtctcattatcaatatcattgtctataaataacacccatatggatgtgcggaatcagaataaatagtagtgctggacgctgttagtagttgcggttgacgtcgcgtagtggccgttgatgtcggaatctcttcgtctgtcttatcacgtcaagaccaatacacaccggatgactcccttgtcacacgcccttgttggacaccagcaagatgatgttgatggtgagaatggtggcggcagagagccagacgagcatggtggaaaaggcgccactcactacgcggctcttctgcttggcgtagcccgtgacggtgtggatgtatgatcgtgccgctcccagaatggtgaagaaggtgaggccgatgaaaatgtagccaaagaccagcgtggcgttgcgctcaaagtcgttggagtcgctgaccacgcccacacgctcgtacgtgacaaacttgggcgtcacatgctggtctcccagaccgctggagttgcccaaatgtggagtcacgctccgcgacttggacacgtgaacaaaccgaaagttgagcagcatggttgccgccgccgagcccatggcgatcgccatcttgatccatgccagataggttcgttcgttggcgcataggtctcggacctcggacgtctggttcgccatgatgatgggcttgtgccacgggtgtttccagaagaaatgcagtcccgacactttgtgcaagtccagcttctgcgccggggtctccgtgcttgtagttaccgaccgcatgggtgttgggatgtcgacggagtggtgagtagaaagttggaaagttgaaaagtggaaatagttggttcttcgacaaagccacacttcttttgggtttcatttcgcttaggttagcatcggaaaaatgttcagaaggagattatgggaggagggaggcacgtggagaggcggggaaaatgatagatttggtcacgtgactacgatgaattgatttccgaaagaattaccagttttgggtcatttttcgtcggttttgttggttcttcgttccactgacatcagctgaatgatcgacttgaatggtggtatgatggaatcaaaatctggagatatggcagtgtagcaggaggagtttttatccgcgaatttgtatggtattcaaatgaaggagaaccactcggcacaagtacagcttttgctgccaagtacggtacagtacgcaggttagtcgtgtatacagggctttactagtatgtgcatgctggtacgtgagacgatggtgaaatttggactcaccgcactacaaacggagtggggatacaagtgttgatgatcattcgtttttgaaccacccgaagaacagatttgcagggttgttgttttaattaaatggtatctgcactttcagatagcactttacagcgatatgattagaccagcgagtttcaactattgtcgagtaactgccgaattattagttgacatttagacagaaaggagttcaagctctccctgccctggctaaaaggtcgttttaccccgattttacgacacggagctgcatgccaatctcaattatacaccacgccaacttggtcaattctgctgcaaatcgcccagaaatctggaaatctgctgataacgatccggctaccattttctccaaagttcagccccccaactcccccgcatcgtccacaaaagccgtctcgatttccatcgccactcgcataaacttttaataagtgcaacaccattcgtcactcttccaacctccgcaaacacaagatgttacgactaggaggccttcgccaggtgcggttcaactcgacgttggccagctcgcgacaaaagtgtctggacgagctcaaaaaacacgacaagtcgtcctacatcatccaatcgtacgtgcagaacgaacatgcccgagacgccttcattgccatccggtctttgtgcctggatctgtccaagctgaacgctggcgccactggctcgcgccgggccgggtccgacgtgtccgagccgtcgcagatcaagctggggttctggagagagggcatccagcgtgtgtttcagcgcacggccgacaagtccggggctctcaaccacccgaccctggcgctgctggactcgactctggaccacgtggatctgtccaaacggtacttcatcacactcatccagtcacgggaagcgtacatgggcaaccggcccttcccagacgttgattccatggccgtctatggtgagggtctcttttcacagcccaactacctgttcctggaggcgacggtgggcacgtcgaaaaacacaaccgaatttctcaagctcaatcccgaggtgcactccgagctgcacaccatcatcgcccacattggccaaggatccggcatcgctgccctactcaagggcctgccgtactacatcaaccagcgcaactacgtgcctcttcccgtccagggcctggtgtcacatgatctgtcggaggaggaggttctcagaggcacctttgacaaggataagctgtcttcgctcatcttcgaggtggccacccgcgccaacgaccatttgatttccgcaaacacgcttctggagcagctcaaacacaacctcaactcggttccggacgcaccaaaaggcggctacttcacctcgtccatgttcctacccatgatgtcatacattcccaccaagatcttcctggagaagctggagtccgccgactttgacattttttcgggcaagctgcagaccaaggacaatattgcactgccctacaagagttggagagccagtcagaccaagagtttgccagagtaatcacggcagtggttggatggacagaccgagcagcgtagccgggtggctggcttgattgacaagagcaagattctttcaatcaagaaaacgacaagtgaccgtttgaactgataatatgtacatagttgaatgattaagaatgatccacgtgatccattcattgttatagcaccaacagagagacacagtgtcagtgcagtacatacattctatacactaacatgtgttctcgacccatgcactttgaagttggaataggagatcaaccaaccaaagaatgttacaagcttcattatcgtgctgtattgtactttccgacatattgtactcctttttttgcgcaatttcatcgaattttctcgccaatatgcccaggccaaaaatctcatcagtaacttctgactaagatggagagaaatacaccgaaactaccgctaaaaagaccacaaaaaagatgctccgcaacggagaattgaactccggtcccccgcgtgctgaacagttgttctgacaggcggaaattctagccactaaactattgcggatcggtgggaaccgggactgctgggaccgatttgaacgaggaaacaacccgatcaagcaagcccaatcccgatccaatgatcatataaattataccgttcgaatctccggaatgatagctttgcattgaagtagtcaaccccgttataacgtatatgtggcgttaagtagatgagttgtcatgtccacaatcagtgctcaagttactcaaggatgtctatatcatacttgtatatctaagggaatgtctacagtagaggaaatgtctacaactcaagcaaaagaatttattgcgcatttgaatgcgtacgtatccgatgaatactgattgtgaagattatggaaaattatgttaccgggtcgattgtcactgccggcttttgatgtattcaacctgacgaccctgcggcctgaggagtctctgtctcatggcctccgtgcccagtctactttctgtcgatgattcggccgaggttgccaaagcaaatggcgccacagaataagttactggcgagccagacgagtccagcccactcaccgaggcccacgggaatgaccccaatggcagacataacggcggctccaatcagcgacgacacggccgccagtccaaacccgttgctggtggtatccaggaggtaccacaggaacgggttgagcagtgcccagatgactgccacctctgtggtcgagtgccaattgaggtttttgacgccgtaggccacgcctaggaacgctcccacggttctgaccaacgagccccacttcttattggggctggatcctccatttttggcccggattcgctgcagacccttggcgggggcgctggtagacggcttgtacttgtcgagaagaggcagacccagacctagaagcacgcagtgcacaccccacatggggagggtcagtttgtcggtgtctcttcgtgtgccgacctgtttttcgtagagaaagtggacgacacagccgtagccacagcccagaacgaatagtagggccgttttgaacagaggcgagttgccgaaggaaaacccggtctgtttcgagggtttcttgatgggcttggagtcccgtttgctgggagctcgttttgtgtacgagaacgacgatcgtcgtcgtttgggcggtccctgggcgtctcttctgagggcggcaaactcgggggcgtccagtcggcccaattccaccgtttccgagtcttcgccgttgagctccgagaggttggtctgcgatccaaatactccaaacaacgtggatgtggtcaggttcagaaatgacttggagtggtcattcgattgcattgtgatgtgtgatgtgatgactgagatctgagatgagagatgagagatgagagatgagaaatgtgagaagaccgggaagatgtgtatctgatgactatatcagctgattgtgcttgcggactgtgtatcgtttgactggttgtgtatctcgtggcagctccgacaataatgtatggtgtcactctatcaggatatggtgcgtaatatatgcagagaaaaaccgactttgcgctgacgtgaacgatgtatgcgaaagtatccaactgtgtgggctgttgcgtcgcttttgtgtcactttttgctcgaaaaaccgtcggtccagtgtcaggcaaggatgctggtggaacgagtgtctgcctctctcgctatcaaagtaaccccacattaggcctctcagtcaaccttatttttgagacctttacgagaaatagtggaaaatgcggaaaattgcggaaaattgcggaaaattgagtaaaattgagtaaaattgaggggaaacgtgaaaaaatgcgtaaaaatgtgggaaaatgtggaaaatcaatgaaaatcaatggaaatcgaaaacagccagaaaatgcaacatatcagctcattctctttgcccaaacgccactgtttcaccactttctgccacacctaaacctcccaaatgcagtacaatatgtagaaaccacctcacagttcgtatcaatcgtatcgcatctgtcgtaataaatcagaccatctgtacttgtacattgtggcggtattattcggcacgattccaattccaaaggttcgagtctcccgaacccatttattacctccctcacacacatcgtacacactcgcaataacgaagatgtacagtaatcatgctaaaaataaaataaaaataaaaaataaagggtcgtgtgcagggtccgttcccatgacaaccgcttcaaaacaaagaatcgacaactgtcatatcagagataaatacattctaccgactgtcaattatacagaaaacccctcggcttgtgttgatttttcctcgtcccctttttgccctttttgccctttttcctcaatttttgcgccattttcaaaaccgacttttgccactggaaatatccttagccgcacacaatatacacggctgagacagtgcgctgaaattcttgtcttgagttgcccaggttacccgggggaggggtcatgtgaccggccctattgtgattacgtaatcttagtgttggtgggcggacatttagtgcattccgcacacttgcccacattcttggtctacagatggtttgtggttgcgatttttcgatggaattacaattttggccattattcgatttacaattttgacaatttacaattttgacaatttacaattttgacaatttacaatttcggcaatttaccgaaaaatacacctcttcaaccccgcttaactccgttacattttgaacatgcagccggctttcaaccaaacgccatttcttgtgtttcagtgagacgctgcagggttcagttgagacatgtgtgtggcaggggcagtgcagcagtacatacagaaatagacggaattaaggggctgtggataggggtattttggggaatttgggtggaataaatttactggcaaagttgggaaattaaaatcatggaataaaaataaggaaaatcagaataattggataagggaaatcaaaataattggataagggaaatcaaaataattgagaaagggatggttgagataaattggttattcacaaccgccggtactgtatgtacattactgggtatcgatacactatctgtatcgttcgtactcatacttgcatcgtacacatgcttatgtccactcaacatcaatccgatacaccccagtttctcagcaaccccttccaccatctccacacactctctctgtcctattcccccctccctcgattaaacattattcattagataggtgttttgttgtgatatgcaatgtcgattagtgtcagtgtcatggtgtccgaggtctacacatgtagtaacccccgtgcggtcagtggctgtcagtgaccatccttgcagtcgccctttgtaaaatcctccttggcaatactctttatcgccacaagccactttgtaagatcgggttccgagtccaacgaaaaccggatgcgtttggccggcgtgatgagctgcatgcagtacggcttggacttggacagcggatcaagctcaaccacgtccaaaagctggtccacggcaatcgtcttgatgggcttcttgtgttggtgggccgagttctgcgacttgtagaagctcagcgagtccaccgtcagaaccgcatactgtcgctgccactggttgtatcgttttttgagccgaagtagcgggccctcggcgatcagagagctcttggacgggctcggggacgtgggagaggttggcgaggggtccgacgaatgaggggggctgtttgtggagatcttggggggtttggtcttggggtctgtggggacaaacgagtcgtggaaatgctgaaactcgccaattgggcttttggacagcggcgacttgtcttcgtcccactcgctctgcgacgaaaagacgtcgtcgccgctgtactcggtgtgcgagtgtgtggcggcgtccatgtgggggctatgggggtggttggagtacgagtggagctgggaatggggcgacgacaccagggcggtatccacgacgatggggatttccacgtggcccttggcggtggacgctgcccgttcgcgtttctgggcgtccacgacattgtctgccgctcgctttcccacctccttgagctgggccacccacgattcggcctccgcgcgggagtcgctcttgaagtggtggttgatggacgacgtgaagacggcgaagttgacatcctccagcagcgccaccgacatgatttcctccgccggaatcacccgcaccggctcgtattcccgctcgtccttgtacacggacagcgcctgggcccgcaccaccacccactgttttttccacgactgagttagaaacgactgttgcgaccacgcggacggcacactcaccttgcgcttggtccgcacgtgtaaccatccacttttatccattgtgggtctttgtgtttgtgacggaggagcacatgtgttggtggaccggaaaggcgaccgactcttgtcaccaccggatcatgtgagctagagtttgggcaactttaacggtaagtgtaattccgagcttaaagccgcggggtgaatttgtaacaaaacaaaatttaaacaaaattaaaaaaaaaattaaaaaagaagataattattgcactgtgaaacggagaaaagaaataataatatatgtatatatatatttcgacggcactaacaacgggaaaaggcgtctaaacaaaagtgattagagcaaaagtggctagagcgcggttggcgatggaaaacgccccaaatgagactgtggcatccccaagtggctccccttgcatctccgctttcaatgcccctttcggctggtgtctcttgtccctttttttcggacttgttcacttgtgcctacattatgtgcagacgttgttgaggtgcgttaagcaaagcaaccgaatgcgagtgagacgagtgagacgagttggaagagtgagttggatgagtgattggaagagtgataggaagagttggatgagtgttaggaagagtgagtggaagagttggacgagtcaacgtctcgccgcggcgatagccactattcattggacttgaccttctgctgaggctggagtatggaacttgcaccatgagtatgagtatactcgtatcgtgctgtacttgatcgcactgtactcgatctcactgtactcgatctcactgtactcattcgcctcgttcgttaccctccgaacaatcgcctctaccatcgaccgtctcccgtccccgtccccgtccccgtccccgtctaccgtctaccgtacttgagcatctcaacatcagcatcagcatcttagaccaagataaacttgtacagtagcttgtagctaatttgtggggtatcaatggagccaacagtacaatgctccaacgatagcaccaccattaccaccaccattaccatccttttcactctccctctccgaccgatccagaccgctacaaccacaatagagctcattcaaccggcaacccaaccaactcaatcccgtgcaaatttgccgcaattccaccacaaacctgtgccaacccccggaacatggcagaatgcaagcacctccgcgaaaagaaagactctgtcgacccgaacggttcggaaagtcgcccgagctcgtccaacggcgtctttgagccgcacaattcgtgtctttcaactccccaaacccccagagccccgagcaactcttgctgtcaagtcgggatctccatctcgagtctaacagagttgctatgttccagaccgggtagcggtccagtgcgatttatccgcaagtaggttgctgtgagtcatcgcattttgttgccaagattgttcgttcgagctctggagggtagcggttggtgactaagcagggggaggggttggggataaaagggccgaaacgggtcacggagcagacatacagacaccgctggaatcagctcgtccggggctacgtggtgatatatgataccgctggcggtattgtcggatcatcgttttggacgtgttccgaagtaattgcaggttcggttcggttcctagtgctcggtctggttgttaagcgaccgattaagcgatatgaatcggaaatgaaataaatcacaaaaaaaggaattaaatattgaaaagacattcgtaccaggctgtttacgcagcaaaagtggtgtggtttggacgaggttgcattacaagtgaaaaagaaataattgaagagtcaattgaaaaaagaaataaatacagaaaatggacatctgcagtttgtgaaaatgtcgggggcagaaaaaatggagaaaaaacatgaaaatattggaaataaacaatatttccgcggattaaagcaggttgtgcaaaatgtagaaatttaggaaatgtagaaatttagaaaaatgcagaaattactcaaattgcataaattctggggaatttccgaaattgttcggaaaaggcaaaaaatcgggaacatcaaaaaatttggaaaatgaagaaattacggaaaatgaaaaaattacggaaaatgcagaaattatggaaattggaattacggaaaatgacgaaaaatatgagaaatatgggaaatgcaaaaaaattgaaaatcacacggaaaagagaaaacaaaatacaactaccgtttatacccatactccatctcatactcgtagaattattttcttatgaaacaaattatattgattacgtcatggcattcagaacaacaccactccttgcttacatctgttgcaagtacgctatgtacctcctgcacactcataatctcataatcttcctcaccctcaacctcacgtgacttctacaaacatgactaaacaatcgcctccctagaatctcacccaccttcaaccacgtgctgttgaagaactgattcaccaatcacatctatctcaactttatttccccacctgaatcgtcgcggatatgaatacatctttttgtccagacatccaattgtggatctgaaaagttcattttgttcctctctttctcttctccacgctcatatttttatcttctcattaacccctctacatgcccctctaatgttcatttcaattcccctccacgtgcagtgacgtgcatgtattacgctcgcaagccaccgttcatatatatctggtagaaccgagtagaattcgttcttcttcatacaccaccatgaagttctactaccacgacaacgactccagcgtcgaccagtgtgcgccccacgactcgggcgagcccgtgacggcggagcagctggagaaaatcggcgttctggcgttccactaccccgatgttgaggacgtgaaccgtctggccaaggagcgaaagtacacaaaccgagacgaggtgaccatcactccagaggcgatgggcggccaggaaaactacgagaagaagctcaaggtcttctacgaggagcatctgcacgaggacgaggagattcggtacattttggacggcgagggatactttgacgttcgagacaaggacgaccgatggattcgggcccagctcaatgccggcgacctgctgattctgcccagcggcatctaccatcggttcactttgtctgagaagaactatgtccacaccatgcgattgtttcaggccgagcccaagtgggtcgctttgccccgacctgtggacaacaatccttatcgacaggagtacgtcaaggccatttctgcttaggatggacatactgagcactgcccagtagtgtcatagatgccgagcgtgtcggagatgccgagcagtgtcatagatgccgagcgtgtcggagatgtcgagcagtgtcggagatgtcgagcggtgttgtgagttttaaccagggcacctgaaacccatccaagttacatggactcttgttacattacttgagacaatgtcgatctgtactgggtacagtactgtgagttgctacatcaatcgaaccactactgtcgactgaactgttgttttcctggcgttgaacttgagcagatcaataaattattcttatcgtggactgtacactcttttgaaaggcgccagagcataaagtgtcacctttactgggatttgggcagacaccaggttgctgactaactttttagtccagtttgaacctgttcagcacctgtcaatcgaccttggagatacccgaaatcccgagtctctactacatccttgtattcatctaaccacaggaaatttacttgtacgaaagaacagcccttaacagtcatctgccctacttgtcgtcattgagttgtttattgatcaataataggacggaagagatatcaaaccgcgattgccagtcacccagggttagtgtatcaactccaacttgaatgaacatattgtatttgaaggacctatatcttctcagatatttcacttgtactagaccacagttccacatttttataactctttttttcgtaacttgttaaatttatttttatttatttatttttatttatatttatttatatttatttatatttatttatatttatttatagttacttacgattttatatatataatacatattacataatacattgcacctcaactaaatcccaacaaaaccaaactaaaatacaacccaaaaccaacgaaccccacaaaattaaaattcacaaatccaatcgttaatgtagcgttacatcaacttctaatcatcctgtactgccaatttgatttctataaaataggtcgaaaatatgttaaaaaataccaaatcaaaacaagtcttgccacaaaaccaacatatccgccctaaccctaaaaccgaaaaccctaacccccatttcaaccgatttccaccgcttttcacctcattcagaacacctgcagctacgcttccctcatgcacccaaacctaaccccacaccgaaacatctccgacagtaaccgccgtaaccacacaccactaaaaagatctcttcgtacattcaaccatgacggccttccccgaatcgtgccaaccgccacgtgacggactgccacgtgagccgctgctgtggatggtgtttgggtcacgtgacgagatcacgccgcacctggtgagcacatgtcttgtcaagggcgatcgggtttttgtggtggagtggaccgagactggcgatacccgtcctgagatcaacatttcgactgtcactttgaatgggttacccggtcctattattgaggcgcgtgcctcgattcccatggccgttttccccggaggaggcgagaacattgtcaatgagctgctcaaccgatgtatggtgatttttggaattctgccgcaggttgtcgtcaacttggaggagcacggattggtggggcctggcgaatcgcagcatgagcacgagctgcgctctaccttttcgcacaactttgggcgggtattcatcgtttgcagggcgattttagcggcttggaaaaaccgaaactgcacagacaaacgagtgatcatcaacaagacgggaactctgggtattctgggcgccccgggcctgggagccttgtgtgcgtctcagtttgccattgacggcttctccgagaccctggctctggaaaatgaagggttcgctaatgtggtcattttggaatcttcaatgctgcatgaacggggtcgaaatcccgtggcggcgctggtggacagcgatatgggaagcccgataattgcaagcagcccgatgagccatcactcggccttggtcggaagtccgctgaacaaccattctcccacgagcaaccagacccccctcaacccccagcattcgcccgtcatgaacaacatgacgcccgtgcaccattcacagacaccaatgagtcaacgcagccccatgagtcaacatagtcctttgacgcgttcagaaacgcccctaacgtcgctgttgcaacccccgttgccggcagtggaagaacggcagttgccagccgcatacgcggactcggcagccatatacggccttcttattgcccagcagctgcgcgaaaaacgacccattccacctcacgtgacgtatgtgccctgcaccaagccgcgtgttgaagacgagcctgtggttcccaagaagcgcaaagcggaggaaccgcctccggcagtgcccagagatagcaccgaggtttcttttgttgatctggtggccgcgaccgtttgggaggctgctcattgtgccaatccccctcttcggttgtgtttgggaagacaggcggtcaagctacacaaggagaagctacgactcaatgtggaagagattgaggactggaagtatctgtatggacattgggaagattgacggcattggcgtcctgtaaataatatttatatggtggaattggtggtgtgattgccttgtccagtatagagcaatcagtgacagtggggtatggggagaggacctattgacggtggtgtatgtgaggagcaatcaaatacggtggtgtgtgtttcagatcagaaatagctggtcatatatgaaacaactggagttgtgctgctaacaacaaactcgtttgtaagccttcaacttgaacagatctcgacattgtaacattcaagttggacaggactgggtattgtagcattcaaaacgggcagaacactttttcaactgatgaatgaattacaaggacttgtattgtaaacagtatacgacggttgacccataaattccctccccgaatgagtggaacaggtgataaccgacgataacagacattagggtctattatggcatcgggactgtttcttttggtagaaacacctacagaaacctcataaacagtcctctacatgtattaatagtcgaatatcgtacttgtagagcccaggagtggacttgtattgtcgtaacacttggtgttaggaaccagactctgagatagaaacattggcacttgtactgacctctgactatagtgagatcagtacttagactgatggttccaatcatttatgagttatttatctggtctgggatctcttgtgaatattaatcacgaactccaaacaagcctgatgtgcactgttatggaactagagtccttggacaaggttgtaagagttaactaaatgtcaattggtatacttaggtttcctgtagatttactatgtttcaagaatcatactcacggtagtcaacaattcaatagactcgtacttgagcctgtaacaaagataaacagtaccagtagaatggactcggattcgggctttacagaagaacatatgacaacccttctccaattgtgcttcccataaccctctcatttcccttctagaccggataaacattatctttttatgtttttattttttattatttatttattattattttttattcttcttagtaagcacagtttgagggcgtattatataatcaatgtatgtccaagaataaaaagaaaaatacaaacttagtcatcacatataatgaccctagcgaggtttgaaccgcggttagttcggaatcccccttgatgacatcggatcaatcagaacggcagttcaatccgtcttgtgctgggtttttcccacccattttattgtccccgttttcctccaccatttccaccaattactaaatatcccacgggcgaactatcaaaacttcctcctaatctccgaaaccccacccaaacacccctgctcaaacatagccacaataccgctcttagcgcgctccgtgcgcatcgaccctcatccctcacccctattccacagactcacccgttcaagtcttgccacaacagttccaacatgtccaacactccagttccgccagctttccgcatcaccacatgcgggttagggtataaaaagtggcgtttagggctctacaggagaggccagacaatcttggactcttggccgccattggctgggacattatctcccaccccttttaggcgtttattttagactcggcgtatacaagtaccagggaactctaatcccaccccttaccctaaactgccagcgtgagaaacatgacaacgtcatacagtagccacttctaaactttagagtttcggagcctatttcaaaaatcactctatttagacggacaaagcttaaataaggttgagcgtcagagtgtcccctcttggggtcccccccacttgtttttcgacgatggtgagaataaggttgggccctaacccacgccaacccaacggggcatgacagccatcttttagaattacccgaccttgcactacatctttggagcttgtttctcacacaacacagcactactcattttcagcgctgcaggtgtatcatcgacaattggcaattgtgcttgagccatcaacgagttgtacaataggaccaggtgagtacgagaccggagcgcgtcgacgcagacgatgacgagacgcacacagatgcagaatccccgacaccggcgaacggccccaagccggccttcttgtaatgttttttgcttcccgtgacacgacaagatacaagatacacgacatcagaacgaaacacgagacccgaacatgacgacacagagataatgccacgtggatggattggcgatggagttggatggtggcgatggagttggatgatggcgatggaggtcggatgatggccgtctgcgatgcatgattggtgatgatggatggtggtggtggtggtggtgaagggtaatcggtgatgatggtttcacaagacccaaaagagggcattcatcacgtcttggcgattggaacgcgtcatcgtcggacaatgacgcttggagtccatcctaacacgtgtccgcagttgtgttgtccatcttatcgccatttttaatcgccatcttatcgccatcttatcgccatcttacctccgccatctttagccatctctttctctgcccttgcctctgcccttatctctgccatccatgaatcatcgaatctgcatcacccgtcagcctcttgggtcataggtcacaccagactctacaatactaacccagatgagcttcccccaacaagtaatagcgccgggccaacggctcaacgagcttctggaggccatcaaacaggagttcgactccgtgaccaacgaggcgtccgtctaccggctgcacaaggacgagtttgacgtcaaggtgaaccagcagacgtcagatctgggccagattcgacagtcggtctacgagctagaaatggcgcaccgaaagatgaaggagcgctacgaggaggaaatcatgcggctcaagagcgagctggaggcccgaggtggacccgctgcgaaccccgcacactcccagcagcagcaacagcagcaacagcaacagcagcaacagcagcagcagaaccagcaggcacaggaccaacaagcacgggccgcgcaacaacaggcagcccagcagcaggccctcgcccagcagcaggccgcccagcagcaggctctggcccaacagcaggcccaggctcaacagcaggcccaggcccaggcccaccacatgggtggtgtgcccccttcgcaaggacagcccccgtcgctgctgcgtccatcatccaacgtgttcagcggcatcatgtccggtcagcccggcacctcttctctggctcccccgcagggacagcccggtcagccccagcctggtcagccccaacctggtcaaccccagccctactccggctacgtgggtgctaacggctacacgtcttcgccacataacggaccccccgtcatcagcgcaatggcctcgcccaacagcaagaagcgacaggtgtcgacccccgttcccggcaaggcgtctccccaggtggccccccaagagatgcaacagcagcagcaacagcagggccctccacagcagcagcaacctccccagcagcagcaacagagccccgaagagatgggcaactacctgggcgacatggacattgagcgggtacctccggagctcaaaaaacaaaaggccgactggtttgtcgtttacaaccagcgagcaccacggctgctggacgtggatattgtgcagtcgctggaccacaactctgtagtgtgctgtgtgcggttctccgctgacggcaagtacattgccactggctgtaaccgatctgcccagattttcgacgtgcagactggccagctcatctgccggctgcaggacgactcggtcgaccgagaaggcgacctgtacatccggtccgtgtgtttctcgccggacggtaagtacctggccaccggcgccgaggacaagcagatccgagtgtgggacattaaatctcagagcatacggcacgtgttcactggccacgagcaggacatttactcgctggacttttcgcgaaacggccgacacattgcctctggctctggcgaccgcacagtccgaatgtgggatattgagagcggccagtgtactctaaccctgtcgatcgaggacggcgtcaccacggtggccatctcgcccgacggcaagtttgtggctgcaggcagcttggacaagtctgtgcgaatctgggacacctctaccggtttcctggttgagcgtctggaggcccctgatggacacaaggactccgtctatagtgtggctttcacccccaacggtatggatcttgtttccggctcgctggacaagacgatcaagctgtgggagctgcaggctcctcgaggcattcaggccaaccagcgaggaggcgtctgtgtcaagacgctgtgtggacacaaggactttgttctgagtgtggccagcacgctggatgggcagtggattctttccggctccaaggaccggggtgtgcaattctgggaccctcgaacgggccaggtgcaactcatgctgcagggtcatcgaaattcggtcatcagtgtggctcctagtcccatgggcgggttgtttgctactggaagtggagattgcaaggctcgaatctggcgatactttcctgtcaacagataatcctgggcggtcgcgaggccggacgggtgtctggcagttaacaaagacattagatgtctggatgaagcctgctccgtttgcacgcaaactagggaagacagggctatgtagtgtataaaattttgtggtattattattagacaaacatggagttgtagtggtggagtatatgcgagtgcaatactgtatgtacttgttgacgatggggtatcaacgtgctatgtatacttgtactcgttcatgtttaccctcttcagacagctggtgttgacgttttggtcatgtgaatgaagataccgggtggagccgaaaagtggagctgaaaatgtccccacttttcaactcagctcggtttctgctctcttggtttttgtctgtgattactctaacgccagcctctctctaatgtccactcattcgccacttaccatgaatggctctggaccttgtttgctcaatagctccacggctccccgtggtccccatgttattgatgctctcggcacctttgttggcaacggctcacggagatcagcagctccacccagcccgctggccaatgccaccaccatcaacgcggccaacgtcaacccgtccaactcgggcctcaaccagccgccgcaggtcatgtctctcaacgagctgcttgaagtgcacaacgatccgcagctcgacgcgcgactgcctcccgagaaccccaaccggcccgtgatccgccaccagcgcgagattctgtacggcaagtggaacattggcccgtcacgggccgacagactggcagccaagattcgcaacaagtttggccccacggcacgcaaacgacgcaaggccatcagagaagacgagaagaaaaaggcccttgaagaacagccgccaaaatacatgctcacggacttccaccatcagctggtgcaggagatgcgagtagtgattgagaaccaggaggcggttttggagcagctcacgaacctgttgtatcaaaaggacgccgaaatcgagaagatgcattacgacatgatgttggtctccactccgccaaatgggaccctcgctagtattcgggaggagcccgtgaggcggtttggcggaggttgtcgtgagtagtgtttcagtggtgataggaccctcgccagtggtgggaggagccgttctcaagaggcatggtcatacgtgtgggtccaccaaaccgcattatcagggcgtatatgaggcatctgtgaactagattgaggtatgttagctacaagtaatggacaagttgagtgttcattcatccagaatgtttcaaaggcctgttacttctctacaagtacaggaacagatatgagcacaatcacaagcacgaaagtgaccagaattcaaatcaattccatcatctcctcgtttcaatcttccaccattttcactcgaacctgttctttgaccaataacatcttatgtcttctgaattggatggacataactggatcacgtcaaaccgagcagagagaattccagtcagtgagcaggttcaagcacgtcatggaacgactattttacaagtacttgtacttgtacttgtacaatataccaggtcaattgaacttcaagattcgtcagtcggaaaacgtgaaagatatcactcacctcttattcaccctaattcaccttcttgctcacatccatacatctgccgactccgtactaacccagaatagccgctactactgacaacgaaaacagtaatattgggaaatacttccgacaaccaacaaaacatcggagaactccaaacctaacgttcactgatccactgaaatccactctccgaagataccctacttctcaatactcttcatctccatactcttccaatactacaaccgttacacaacaaccactttcagcccgtcaaaacaccgacttattccatctcagccaaagttcataactgtcatcacttattatcaccattcaacggaggtgtaaacgtacaatacaaactaccgtaccccttaccctgtaccctgtaccccaaccctaaccctatcatgaacccctcaaaaagaaggttgaagtatggcgtggtcaaattcagttacccggccgcaaaacgcaaactttatgtgattagtaatcacaatagtacaatcaactacgaaacgctacgactttggaggacacaaatccggcgaaaacaacgcccgaagatgatcttacgagtggctagaacaatggtatcccttcgccccctcatttccccgcagtcgatagagtttaatacgcaactggtagcgtatatatccgagatggcctcaacttccacaaccttctcacggaaccctaacccacaggttttgggaggaggcggcgccccatcgatcacgaggtttggaaaaaacggcgtgcttgacgaggaggaaaaattcaaaaaaaaacaggccgtgacgagacacacaatctttcaggcgacacagcggaatcgacgacaagaccaagcagccacagcgagaggaaacgggcggagaaaaaaaccacaccaacaaacaaataataactcatctcgccacgcaacatggccagtcgacgatcaagatctcatgcggtttcgtctgcggagccggaatccaagtccacatcaccgccgcccactgacgcgctgctgctgagacggctacagaacgcgctgacgttacccaactcgtttctcaaaaccaatgggatcgatctttcggaagatgcacgtgtttctgtgaacgggctggtggagctccagaacgagttgcggcagattcgacagaggacccgtggcgtgctggaaaaccacaaggccgtgattcgggccatcgacgaaacggtgggacgccgggagcgaaagggaggcaagagcggaggtaagggtgtcggaaagggcaagggaaaaggacccaagcagagcagcagctcgtcgtcaacctcgtcgaaaacagcagcagcagcttctggagggtcttctcagaccgagaataaggacatcaaaatggaagatgtggacgaactacccgcggaaaagaagattgaaccggtcaaactcaacattgatagcgatctaaccacgatccaaacctctccccccggagagggctcccccaaggagtatgaaaagaacccaaagtccgagtttgtcgactcccagacgctgcccctgtcggtgctcaagctctacgacgaaaaaaccatcccttacaccggagaggaggctcttaagctgaaatatggagtcgcctcttaccctaccacggacctaaaggaccagttggccggcccaatcccggaccaagactacactcgggccaagccgcccaaccaggtacagttttcgacctttgcgactgcgatcgagccctactttcgacccttttccgaggaagacgtgtccgtgctcctccaacagtccatcccgcttggagccacgggtgctccgctttacgccacgggcaaggatgcagagatctcaccgtacctcgtgccccctttgggtcccccctacaccgacgcgtgggctgctgaagacgccgaggcaggtattgctgctggcaacgcagcctcagcgtcccggttctcgccgcccccaaagacggagctcgcggagattgagcccaagggcaagagcgaggatctggtggacgacgcgctggagagctcggacattagttgcggccctctggcgtcgcgtctgctgtctgcgctgctcccggaccccaacaaaaaggaaattaaggaggagcctaaggacgacgagaacagcgcgacccctgccgccgcagtgtcgtcttcgcctccacaaagcccgctaatcaaccccagctggaaggtggcgacagccaagggtgactatctgacgctggagcagcggctcaagcgcgagtttacgtacgtgggaatcatggacgtgaacaaaaagaagcagggcaagcggttctccaagcgcgacgacgagatggacctcatggacgatcttgacgacgacgagaacaacgaggacctggaaatcgactgggtgcacggccgggaggacgacgaaatctgccagcagatgcgcgtgctgcagaagaagctgcgccaggtgcacaagaccaaccaggcacgcaaacgtatcctactgcccatcgtcaaggagcagatggcgtaccaggaattccggcagattctggaggacctggacaagcaggtggaccaggcctacctcaagcggatccgcaaccccaagtcgaaaaagaagaagcagcagaacaacaatggcaccgctgtacctcaggagcggcccggtcttcgagtgctgctggacaagcgaaaccggtggatcgacaagattgggcctgtgttttcgtcatctccacacgacatgaaacgagtgccgtctgtgtctgtgtttaaggatcttgagggcagtgatgatgagagtgacggaggcgagtttgacgactccatgtttgtgcagtaagacgctgatgtgcagtaagacgctgatgtgcagtaagacgcagatgtgggtgctgggaaaagggtggctattgccgccccatatagtatataatagaatggatgggatggtgacaattgaggtggtgacagatggcagttgcgtcgcgtagagggtcagcgtacttatattgtagtgtgttctgaggtctgaggggtttcaagacaagagacaaacagaggtccgaggcgaacattgtgccagcagttcgtacagaatgtacgacatacagtacatactgtacagaaatgtacttgtagtggcagacttgaaacattcacaaggagatttccgacatgtgcccggtaagaagcccttgtagccacggtttaaccctgctgtagctgtaaccatcctctggctcacagtaaccatgcggaatgtccagccctgttctaaactccattattgtacggagacaactgcttttgctgggtgactgacagacggtgatcaagcgacgactgaggtaagcagtaacttggtggccgtagtggagtggcgagcggggttaggcgcgaaacatggagatactagcggtggtcacgggtagtctgggtggtttgaatccatgttgaatgtctagtatcattcctggagacaatgagtcgtcatagccactctatctgattgtggcattctttgaaaggaagagtgtaggaagaatgggctgaatggtgagcgagagtgggagtgggagtgggagtgaaagagtggaagagtggaagagtgaagagtgggtggaagagtgaagagtgagtgaaagagtaaagaatgagttgaaaagtgaaagtgagtgaaataaaagaagatataagtatttgtcagtcattcaaaaccatctcttaacagaatgtcacttttctcactacaagacaacaacatacaataccgtcagattcgtgataccagtacaaccaccgtacagaaagtactcgcgcccgaaacaaacattcttgtacctcaaatccatcatataagacacccacattgcaacatacaacacccacactttgctttcccgtaaaccatgctcactctgctaactcttctcactctgctcactctgctcactctgcatcacatcaactcctaaagcatcacggcataatcgccgaataaaaagcgtaggaggtttgtcaaatctcgtgaccaccagtacaaatctcacgtgacgaaataatatgacaacctccacgtgacccgttctttcgctctaaccggcattgctaaaccgcgcatagcagctgcatttgcaggacagatcaaaatgcgtttgtcacgcaaggtcatgtcgggcacagggctagtgcacgacgttacggcagtctcatcttcatcgttaaatatatacaggccattccagatggctatgctatgcaagggacgtgacggtgagggagggtgaaggggagggggagtagaacggagtcaggctggttcaattggcgtagggctttggcgtagggcgttggcatagggcttcgacgttggtgtcgggctttgaagtagctcaaataactcaactcgcaactcgatccagaactcgcaacttgatccagaactcgtctcgtcctagactcgctccgctcgcctagtcctcgcctagatcacgactcacgctgcttctcatcacccactcgctttcgaggacagtagggacacagtccgtgggtgcatcgcttacaatcgtagcgggtgggcggcttgccgtggtactcgccacactgacagcaataccactctgtgattgtgttggggtccgaggggtccaccatgacgaccaattgtttcattgtggcaagtgacgttggtgatgtggtgggtggagcgggggcaagtgtatatataagtatgtgctgttccggtttcaacagcaggttggggctgtctgatcagtcgggtgtgtgagtgagtgtgcagttggggggtgtcaggcttgctggatattttggggctagcggtcagacacgggacagtttgagactgaaacggtgggcgtgttgatgagcgcgatcttgggtgactatggcgggttcttgggatgactatcacgggttcttgggtgtctgtgtcggtttggtacgtggtctagaggtcgggaggcggcagataaacaaaaaaagaagccgactggtgggatactgttgatgtctggagactctttctgtctctttctgtctcctctctcggagtccaccctctctccttctctccaaagtgtgggctcaaacataagctcttatggtttcggctctttggggccaactctacccgcaatagacgctttagctcatccgcaagtgatgcttcaggctccattgtttttcatttgccgaaacacaaatcggaggagatggagatgatataagttcgtcggtagtgggaaggcacgaaaggtgacggggagaatggatacacaatcttgctctcgctccgcggttaattcctcttcagccgttctttttggcccgttccttactccatcctccgttgacggcccattacagttcctggttttgcctctggcaccctttgcgagcccaaaacagcaccgtcccaatccggggccgccgataaaggggcatctcttttcaaaacggcgaaactagtacctgatttgggcgctgcaggcgtatccaacctgccaccggcatatgacggccttccacacgtcgaaaagcccgcaaactccgttggcgcgactccaatgggccgtattggcctctcgtgacggtgctgtcagttgactgagacatgcagtggagtgcagcggtgcagtggaccgtggtcagcactgcctgtttgcatgcagtaaaacagaatctgaaacatggctgaaaatgcgcatcaggttgggctaggtggtagttcgtgctggtacatacagtacgagtacgagtgcgagtacgagttatcgtgatatgaccataggtgataagcttcccctctgtccacgtgaagcttcaacaagtgtctcaaatggtcgacttgccacaggtacaattacgatagtcggttttgtcgctttgaccgtcaaagatcaattcgtccccaacttacaccgagaccgtacaactgtcgggtgacgacgtatcgtacatatgatgcgtacatcccggtaatacatactgtacagttcctgtcgtacatacagaccattcaggcacccctcgctgtatactacgatacgagtcgtgctaacaaacagtcagaatgctatttgatctcgtgtccaggtcaatccaacaggatcgaccgccacgagcttcatactctatcaactatcatgaggatggccccagatgcataaatgctgtccacggagatgcaccgggagctgcatagtggtgacgattttccctatactatacggctcaagggatttggtgcagtaccgagtacacacattggtgctcacattggtctcacattggtctcacattggtcttaccgcactaccaatggcgatagaccgcctcagcttcgtgtctacccatattggaaaattatcgctctgtgcgattagccaggaacacagtttgggatccaggggctggcgataataaaccctgtgtgcccctgtccattgatatgcggatattctgctatgaaacggtggctttccatgaagcgcgcggccaaactcgcatctcgatgcgggctctgattgaacatggcaccatacaattgcacttctcatgggagtgcaagacaagaacggaaacggtacttgtaccatatcgtaccttgctcagtcaaatgactcactgtggagaaaaagtggtgctacttgcactgctttgacacaagggcattgacagttgacagttgacagatggatgcagcactaatgatgtattgatggtacgagtgtggggaaatggagatggtggaatgggaatggacgaggcgcggcaagattcaggaactacggacattgaatcaaagattcgcttgtttttgcggggtctttgccgcccccgaatcatctccatctacagagctttctgcagcgttttccatttccaagacatgcataatgtgtccgaaaaggacatgtatcgccgaagaggcgaagaggagtaattaattacgtcgcacgtgtcgaacatacgatgccgcgtatttggtgatgtgagctctacgctcattggtggtcctactcctattcacacagtacgcacagtcctgcccccaacgcttacagtagttaagacttagttgggggatagttggataaaaagtgtgctaggggttgctattggatgttacaggaatgggacagttataagaaaatacccagctgataaaggacgccaatctaaccaaatatgcactcaaattccctcactgaagttcaagtgtgttgagatgttacgaaaccgatctcacaatatttgatgaggttatagttgggttttactggagcactaggtagttctgacagcgtgggtctctctatttcctagaacgactacatccgaaaccagcacatttgtctccaaaatggcttaatacgggatgaatattcaactgcgaagggtcggcttattctcaggggatccacactcgtattgttctttttgggtactctgtttcggttgtcaagattgctggagaggtcactgcgacagagaagcactatgtactacaaaatgtgcttgttgtacaactcgaagcgctgacacgacggaatggaacagccaacccatcattgaagaatatctatgggagagcaaggtcagcagttggcattctgaagtacctgtgctcctgttggaatgggcctcatgaagcaacacaaggacactgactgactacgatgagatgagacaattggtgttacgaaaaggacaggtactcacaatcacccgaaaatggaacatggaaatgagaactgagagttcgaccttgaagtaccactaatctggagactcaacaagtggggtaagcaaagcacatccaatgccatggtggtctatttgctatcaagattcacgagcccttcctgttttcaacaatattcaacgaccaagtggctagagtgtgcgaccgcaaccacctcttccgagaaattcccactagcaaccaacattggagagctgcaagttcccgacaacgggaggactgtctcagcgtcactcacacacgtccaacaaatgagtacaacaacagtgaatggaccgacttcctaatctgctctagattcttgcctattaaagccccatctctaggtctgaactgagagtttaacagagtacggcttcaactaccggtaacatagccctgcacacgcctcaccgctagcactgtagctgtcagagagagcacagccgatattcgcgctctaaatgccgccagtgtacggtagcgatccatggaaagtcttagtctccaatatccaacatagcagcctatggcagcccaatcttgcactgttttcgactactttccccagtcatgtgtctcagactaagacatggtagaaagtatcaccgactattgaggcaggagtcgtacggaatgataccagtagagtggtcaggagtgatggggtctagatggttgattcaagaggatttgaagtctttgttgctgtattttagcagtgaatagtagtgcttacatcatagctgcgaatgggcaactcttagcgacatgtataacgtaccccacaaacacgtagacaaacaaacaaaccaactctgtagagtcgtaccttgggatgcgtcgtacctgagattttcgccagacaggtgctgattacagactgccaaggacgcaagacaggtgcctattacagattgccaagggtggtgctactccaattaattgtagtaagcgtagcgccacgtttaatcacgttcagatgtcactagcggagctggaggaacatatttggtggttctgctacttgtagccccccgatatggctccacttccactttagtgactctggttagtggatcacaagacccttttagcgtatttctttttgcaaggttccaggaccactttttacagtttgcgataatgcaggatgtcaggaggcgggcttggcaggagtgaaaaatcggtgatagaagtacgcaatatgagatttaacagcgggaatcaactcctttagcagtgattagcccccaataaatgttttgggcaaatcccgtaggaaaccatcaagttacagacgacacaaatccgtctagaccaccccacaaagcttggtatgcatacgagtcatacgacaaagaacaaacaagcacagagcggcagaaacatggaggtggcgcaacagagggaggggtagaggtcatatgtcagagaagtatatatagagggaggaacttggcctggatacaccttccaacccccaaccacctacaactacagttcgatactacagccacaatggagcccacaatgtccccttcgcagcaacaggcaagcaagcctacgctctacaccattccaaactacgactttgacgccgacaagcctcaactcaactggtccttgactcaaaccattctcgagtacattgcttcacctttcagacgacagaagtaggatacaatgatgaatgaatacaacgatctttggttaatgaatacggtaatgaatcgataatgagttgattagttagagtacagtaaagagacatgctacggggtgtacaactaagactgcctaaacaagttttgctctcttcaggtcaggtaggacactgtatagtcaatcgccttataggactgcaaaatgaaatttgaaaagatcaaagtaatcctcagctgcccaggagcaaaaaaaatgtaactcatggactggttcctacatcagatcacgtgatagattcaagcgccaccaggcggcatgtgttcgactctggcgtgagtatttttcagatctctccttgcacgataaagttttcagccgtatccgaatacgagtatccgttgcgggagatgagatcaggtgatttcggttgagagacaaaaagaataggggttttcgtctcgaatgatgactgtttgagagtatgtataataatatcagcaaagtcgacagggtcatttcccactagctctccttctcactctatgggatcaagtacttcagtagagatatcagtggctccaatatgacagtagtttggcatttaccataagttttcaccgtagaagccgtcaacatggctcattaattgggaatttggaaagtgtattgaagaaccaaggagaaacctgagaagtagacaccttatacaactatgcgcgcggattcccatactggttgaggttagagggcacgatagtccagcgagggtaggtacggtacggagtggtgagacaatgtggtcctggctggagcaatgagacaagagtttcaacttcgattttgtcaacattcaacctcgtccacagcatcaacccctagggtacaagtgcatgatgtgcgctgttatattagccatgttcaacggctcaaagagttgaagagcaagttgtctggcttaagtatcagtgagataatggagaagttggtcctgcgccggtttaccaaataacccatcttaccgagaaaccacaagagccgtttcctccagctttagcctatcaaaaacaggggtatgcgattcagaaaccagattgcatccacaacaggttgcttggactcaagagggctaattcagcttgaagctggtgaataaaatgaacttttatataacaaatacattagcgacttagatatcaccttttggaaggcattccgatataccatcgaatcttggagctcataatcactccttcaggaacagtccttgagagaagtcagcttctacctcgaatttctcaccttggagcacatttcctgaaagaaaaggtcttgttacttgcgcatggctcaggccccgcaaaacttgcaacctggagtcaaagcgcctggtcaatacgccctggcagggactttagaccgcttgctgctggtagtagttatcacagaggtgcttagttgtgtctgggacgtgaggagagtttgaagttctgtagtggttgtaacaagtactgaccgagtggttctatcactatttccgagtacttcggtgtccttctcatcgtattcgtgtgcaaactacggtacggatagcttgacaatctctggaatatctcattgttaaatttacaaagatttagttaagataatcgtctatccgcaggagttgtaataaaggtgagttccacatttcgaccaaactgacgaccgagatatgtgtattctttgaacgggctcgatttttctcggtataatgtcttgttctttgtatataggcgtactaggtacgtcaactttgttaacaatcctccacatctcgcttccttcgcttccgcaaacaccatcgccttaaccatcgctcgtggcagctaaaaataaccacgggtcaagttgtgcatcgagagctccgacatgtgcgtcttttcggcttctcctgcatgccgcgataccgcacgctcgaaaatctgcattcttcactgcccgctttatccgctttatcagccgaggctccttgtctgtcgccttgtttggatagggccaaatctccggctgccgatcgtgcattcggggggtttgcaagccccgtttgcaccagctgaataagcagagagacgtggacgggacggccgagtcatcagagcgctcactgctcaacacgtgcccaaggcgttggcatgcggcggtggagctgggtcttgtcgcaacgggcctcggctcgtggaaacgccgttagaaaaagtaactagtctactggctttatatttagagtcttggtgggaagtgtaggacagataaatggcaaaaggggcctctaacgggctgaataccggacaaaacgggcgcaaaaaagctcgcaatcacttagaagacacggaaatgacaacaaaacgtccaaaaaacccccttttccccgcctaatagcccattgatcgcttgctctggccaaagtaaagatgcgtctcggctccctctgtcctaaccctaaatttccgccttgacacaattctagaaattagtctaaaaaaatatactgaggcgctgacacaggttacatctggacgggacgggtgacattgacgtgatcatgtgaatgccacaagacggggaggggcgatacgcggacattggaatcgcagaatcacgccaatctcgcacaaatccgccaatctcgcacacaaacaaaaactgcccatttccgcacactgccgccgtattcgctaacggcttttgtttgttgccattctccaagcccaacatctcatcccacttaatagccttgatcatcgccgaaccttgcatccagcgtggcagttagggtgagtgttaaagtgtgagttgccttagtgcccttttagcgccgtttagagtgcatcggttggtctgatgagcttggtggtctggaggtgtgagggaccgatgagcttggtggtttggaggaggaggccgagtcgtgacaaggtcgtttcttgagggtaggagtacaggaaacttgcacaatgctgtaattgaccgtgtcgactgaacccgcacattgttgtcatgtgtatttgttgagttatcgtgtcatatcggcttcatatcgtgctcattcgtattcaatactgtacagtacagtatgggatgcaagcaataccgaaattatgtctcggttagaaattgctccagaaaagagcaagtcgaaagacggttggagtccattcctacaagtactgtagcttggcgtatgatggcgccttctggtagtaaacccaccactgctttcagacaccgcaaacgccccaacttgtatgctcttgtacataccgtactccaacgaactggccaaacaaatcaaccaccgccaccacccacaaacttgccgaataatatccaacctccaaatctgcccaaactcactcttttgttcgtctaatagttgcccctgacactgtgccaagagcttatcgtggaatgcttgacagtagccgtagagaaagcaggagaagacatctgacaggtacaagcagagcggtcctcggagaccggcaaaggagaaggaacacggcatgacgtctctctcagtcacgtgacctcgtcttcctcccgcgtgtgttcctcaccatgccgaccattgtattgtattcgagtgtgttagccaaagtcaaagttgagtgtagcaaaatttaaaaaaaaattcaaaattcaaaattcaaaaaaaaccgacacacggctgcgacaaggtttaaccggctgcatacgcatatagatgcgtcgatggacatgttcataacatcgccaaccgccctttctttcctctcgcaaaacctctgctctcgcccaaatgaccgacgataggggcccaggacacattcccgtcgacttcaccgagccccgcggcgccgacaacttcacaacgccgccagattcgcccagcgacacctcctcaaccgccaatcgagacccccaacaagtggacccgcagcccttctacacagacattgtcgaagatgacgagtacaaccggtacaaccacgaggagcaggagctgcaccggatccagaccaacgccacgaccaccagcatgaagtcgatacggcgtacaggcactctgttgggcaacaatattccgtacaaccgagcatttcccaaccgtccaccgggtcgaaagcgtcaaaagctgctgcaatacttttttcgaccggcgtggctgttcgaccacatggacattatcagtttcaagacggtgattcgatcgtggatcggagtgtcgttggggttcatgctcatgatgatcccggcctttgtgcgatggtgtggatcagccccttacctactgcctgtggtggccgtcattgtgcccgccggctcgcagcccatcaccgtgtgcttcatcattaacgccatcatgtgtctcttcacctgcatgggctacgccgttatggtgattgcaatgcgaatcaacaacacctggttccacaatagcatcaatgccgaaggcatggcccgacaaatgatccaggagggtctgtgtgctgctccagactccaacgaccccaactcccgagccaccctcacagcctgtgttatcgaccaggtctacgcaggcaagtttatgactgcccgaggctctgtggtctactgtgtgctgctcggagccttcatgttcttcatgctgtggatgaaaaacaagtcgcgaattctcattccaggctatctctgtggagtcattgctgtgggcgccctcatgcctctggcccacatgttcccctacttttcgcccaacaccattggtctgaccctggtcaagcccatgggactgcagtttgccatcaatgtggctctgtccatcctagttttccccttttcctccggcttccagttcacccaaacagccctttccgaactcaagattctcgagggacttgtcaagttccacgaaaacttcatgacctccactcttccctccaatgaagccgactggctcaacttttctcagaccgaggccgatgttcagaaagctcgtcagctgtaccccaagctggaagcagaagctgcgctgcttcccattgagctaacttactcgcgtttcgcctttcccgactacaccgccctaaaaacaagtgttggccgggttatttccggcatgtcaggacttgtgtacttttacgacaacgttgagaacattcgacggtcaatcttgctggttgaaactgccggaagacccattgacatgtctcgaaagctggctgactcgactggaaacgactccagaaaggttgacagcatgctcaagcgtcgaaagaaggatactggccggtttgacattgacgagaagaagaaacctgctcccgtgggcgtctacgagatcaagactggaatcaagggtgccaaggcccaataccccgattctttgaccatggaagaacttgatgcactgatgattcagctgcgagaaatgtctctgccttttgttgagcaggttcgacttgctctggagactatgatcaagtggttggctgctgccaacgtctacagagtcaacagtttgttctttttctggcagaagaagggccaccgccagcgtcagaccgaactcgccgctgagcttgcagagcgtcgtcaggcgttcaaggaagctgcccacgacttcctcaactccaagcggttcgagctgttccagtcgctcgaagactcagatgagaagacgtcctttgtcaccttttacttccagggtgcgctctactgtacgtacatgaagggagtagccgagacgatcgatctgctcttcacgacgctctccaacatggacgagaccgagtccaagccctcgtggaccattggaaagggcagctcaaagaacgacaaggctaagtcgactgaggcagctcctgctgctggagagaatgccggtcgaggatcatccgaagaggagtccgaatcatccgaaaccagcggtatttggaccggagttgaacgagaactcaagagttatgctcatggccatgaggagcatctgtgcaacaacgacgatcttgaggagctgtacgctcagtccatccatggagccggcattgacggggaccgaaaacgaaaccccgatgccaaacctcctaccactcgcgtgggaaagtttggtgtcaagctcaaccgtgtcatcaaacatctcatgtctccagacattatcgttccgctcaagggagccattttcactattctgtgtgctctcccgttctacttcaagtcgacggctccctggtggcgtgagaacagacttgtctgggctgttatcatgactggtctttcgatttccgaaaacatggccgacaacctgtacggatttggctcgcgtatcctctataccttttatgcaggagtcattggtatggttgcctggtacatttccactggtaacggagacggtaaccgggccggattcatggtcactacttgtattctgtactttgtgctcatgttctaccgtgagttctccgttcactcgacgcccatgccccagattgtcatggtcgtcactaccgtcatcattcttggcatgtcttggaccgacggaactggtgtcaccactccctcgatcggtgtgggctttgctgttgcgtggaagcggttcgtcactgtggtcattggcctgtcttacggcttcatttgcacccttctgccccgcccagtcaccggcaagaagattattcgaaccacgctcgccagcatcatcaaggacactggtacactctactgccgcatttccgactttgccgtcggtcgactggcccacccccacaaggatgtcgatctcaataacgaccccattttcaagtccattgtcggcgcccagaacagaattgcaggctctgagtttctcgccagcatggtcatgtatgagccctcgctgcagggacaatggccctccaaggtgtaccgggaaatcaccaccattgtttcggagctggtcgagctgcaccatcatctgtacattgtgctgcgacgaatcgaagatcctcgctactggtttccgcatcttctggatttggtgggatggggcgaccagccactcatgtcccactactttgccgtgctctacatggcccagggagctctctacgacggctctcctcttccccaggtgactcccgccatgctcatggtcgagcacctagatcatcttgaggggctgttcaagacctcctttgacgctgaggctagacattccatgggcgaaagcgcccgatcagactttgagccacagcccgagaccaaccagatttcactggaacgtctcaagagcaatgacggtctcattttctcagctgccattgttctttccaactgcatcttcgaccgaatggaccggctcatgttccaggtcaagacgctggttggcgaacagtttgtcaactcggagtactaccgcgatcgaactcgtttcaagaacgacagacttgtctaacgtgtgtatatatatatatattaataatgtgtttttgtatacaccaagcgtagccgaaccaaagtacatacttgtagataggtccagatctgaactctcaccacttcataaatcatcaattatgctatcaattagtaactaaatataaatacttttcaaaagaaaggaaacagtcgtcgccagcctcccacttgacgctcatcccgcgcatcctgctcaatctgctcgtcaatggcctgcacgttccgctgtacaatttcgtgcgccagggcagacgcctctctgttctgttgctgagcctccgtctcggcttcagcctccgcctctacctctcgcacgccctccactgtctttttctttggcgctagtcctggttcgtcggtcgcctcgacaatcactgacccgctcgcagaaccttctccctccgtgggtgcctccatcacgactatggtctgtggctgtgtctcagcctcctgaacagattcctggggctcaacaccctcgctagaacgtgtcgtagatcgatcctccaactccacgtcatttccaacatgtccattgtctccgttgcctcgtagattggggttgttgcgctcctgacgtcttcgataagctcccataaaaccgttcaatgtgaaatccatgcgtcctccttcggcgtctcgccctagacgaatcatgcgctcccgccggacagtcaaattggtgatcttgacacccggagggagataacccttgggaagaatagactgcttgcacaagggacagagacaagacctggtctccaaaaatggccggatgcaatcggggtggaaaatgtgccggcatggcaactccaaaaccactgtttcgttctcctcgtagtcgtccaaacagatgggacacgatgactgagagtagccctccagactatgttccggtttcgattcgtccgtctttttgtgagccattttcagccacttggtctttcgctttttgctcgccagatccttgtccgtccatacactctcttttcgggccacgctttcataatgcgagtcgccggagtggtacaccttttcaggcagacgagcaatgacgtctgttggagcagaaacgccaatgaagccaagctgttcgagatcaacctcgccgtttcgcagtctagttcgcaggtttcgtcgccgcttgtactgcacaaagttgagaatgcatgacagcgtcagaatggccaccagaatagaaccgacgatcgccaggacccacacccacagcttgggcatattggagcccgactgcatggccataaatcgtagacctacacgggtcactgtcggctcgccccgatcaccgttgtggtagtaggtcgactgcggcacctcggcaacgtgctccacccactggctcatcatttgggccgtggagtactcgactccgtaaatgctgatgcccaggcccggtggcagcagctgggtgatgttggaaacggaggatgcggggctgttggggtccgaggcagccaccaaaatcgtatttgccgacgtagaggtgatggactcgaaaaatgcctcgttgcattcgtcggtgccaaacggaatcagagcagccgactccacaaaggagacaggaccctgcattttcgtctctgtatagttggttggcgtgtaccactcggggttgcactggggcttgtcgctgatggtgggcacgtatagcatctggacaaggggcatgtctcctgtgtccaacaccagacccactccctgaaactgggccgagttcatgcctggagctgtcagagtcggggcattttgacgagcggtgccattgataggtactgagtatgctcgggtgtcgatgagtactgtgttagtatagaacgagggctgttgaccgcaacagatgagcaaataacgtaggacaggatgagactaaacatagttggaacagatgggcagtagaacaaaccagacaatctactacataccaacaccgttatcgcactgtactgactacaatccaacttatccatcctctcacaaaagcatctcactcagcttggcttgacagggatagcaggtggggataggtcagagataggtcggtgttgtagcatcggaagtcaccataaccgcagcaaactattcctcgtctctgagtatttgtagtcgtattgtagtcgtattgtagtcgtattgtagtcgtcttggtagtcgtcttggtagtcgtcttggtagtcgtgtaggtagacgtgtaggtagtccacataccatctgtctacttgtactgtagtcaaacatccgagttcctgggttcaaaaccactgcaagaattgttgtgtttgcctttgttgcgtctgtgtcttctgtgtcggtttgtgtctgtttcctcgctgtctgtaccatctctctctgtcatgtctccttctccttatcactcacttgacgccattttagcaaatgattcacctctggtgggtataggtttacaagtgatgggccatgcatcatgcacaatagttgatacgcaccttgtagcttaccctaaccttgatggcgggaattaggtgtccccaaagcggtgtttttgcgcctttttagcgctgaaaatcgatattggggggaatacgacctatttaaataccttcacatgtccattttttctccaaactgtccccaaatatctccaaatcaacgccctcggcccacggctgaaaacgtaaaggccgcacatgttaagcctcgttagaacaagcttatttccagtggggaaaccagagccatgccaaccgatagcagatatccggaggcaccgataaatcacgtgcacagtccttttttggaccgcgaagacacatatcattattagtcacgtgatactggctcatttatccccgacagtcgccgtctcgtacccctttgtatccgtagttgtcttgcatggtaccactctgcgcctttgcatgatgttgatctgcctgaaactttcgtctggaagcggtatatgatgactaatgagggtaataactggtatgtaaacgaagtgagagcggtagtgagtcggtgcgagtgttatcgacagacttgaggctttgaatttcggcgtcagaactgcaattgcggcttcagaaacacaatttgtcagatactcattcgttaaacaactcctatccgttcttaactaaggtttaactggttgatgagtattagtactgattatacaatgcctatactagtccaataagtttgttaaaaatgtaataaattgtatatatattttcagaacacgttttttatgatatagagggcaatttccgtcaatttctgtgatcctagcgtctttaacacgtcttttatacgcgatgtttggcggaattgtctttgacaaatttgttcatgattaaaagattttaagtaaacctcaacagtaaggagataaacagttctaggagtgctcttcaaaacacgatatcggatcggtggaaaatacgccattgtagatgtaattattccaataaaaacacaagcgagctgaacaaaaaggtgattcggcaaagcaattctgcaaaaagtgatttctggcaggatcgaactgccgacgttctgcgtgttaagcagatgccatgaccaactagaccaagaaaccaacgaatcttgattgaaaaaaaataatgtatactaaacctgtcattcgcttagtcatcctcctcacacagataggtaaagaacctcaaagtgcttcagtttcttttatatactgtagttttgcatataaaatcatctaaacatgcttagacatggtttcgcttctcctgactaccgtcccgtcttttccagatctgatatcatattgagtggtctggagttccaataacagattaaatgtgtcatttaaaaacttattcagtacaaggactattctcttatcgtaccagtatacatatattccccaaattctgcaattttgtcttatcttagcgcgttttaagcgtcattttggtgtggtcactttggtgtggagaacgtgatgagacactggtaggttctgcttgggtgaaatgtccagcaactcgcggagatctggagttgatttcttgttggatatttgtgttcctagcttgcgttgatgctgttctttctgttaccaatagttattcatgttgcttgactacattaaagagacattcgctttgagaagtggactagttgataaactggcgaccacgcctagcattactacaatattggctgaatcaatacagcagtgtatgactacaggcacagaccatcccccgtatacatacattcctgcatagaacgctgcgctattgatcttagacacttcacccaagttcaatacacatgacattcaaagccaaggagtcattcaaagccaaggagtcattcaaagccgaaaattcatggcagactttgtcaatggattatttcgccccagaagattcgtttgatcaagtccccggcttctctacttctgtttttaacgcccatattatcgaaattgtatgggtgttttcagattctgaaagcaaaactgaaactcctggaagtggggagacgacggtggacttgatcgcaacacggattgaaggattttgtgcaaaactgatctatttctctgtcccctcatgatgcttgtgtatgcgattcagtacctagacaagagcaccaaaagtacagctgggtcttcgagaagacctgaagatggaaggaggcgactttgcgccttttatattggctatctgatcttcgagttcttatctgtctatattctccagcactttccgctcgtcaaaactgtgtctgtctttatcattctttggggtcttgtcctgtgtctacaagccgcttcaaactaccctggattcattgcgttgcgggcaatcttgggcatgttggagtccgctgtgactctctgctttgtcattctcacttccccgtggtgtaagcgcgaggagcagtttctgagaacgtccatctggctaggagctaacgaactgggtctcatggtggggagtttcatggcatatggacaggcagccaatccccctcttacaatagccggctggaggctcattttcatcatcactggcgtcttcaccgtcgttgtcagcataatcgtccttcgaaacaaaaaattaaagagagaacagtccatcgaagctcttaccgacacccgcacttgaatctacttctgtttttgcgtcagccaaaacttttcaaacggaggcatctccaacttcaacaccatctgggacccattcgaggacagtttctgcaaactccccagggaaccaccgagttcgtgggctgcattctcttcggaatcatcgtccattacttccaaagtcgacttttcatgtcgctagtggcccagctcattgggtttatggcaacctgtctgctcacctcgggggactccaacaccgtcaacgccatccttctcataggagactgtctgggcaacatcatttgaccccagacattcagagcctcggacgttccagtgtagctgccgacaaagttgtccatggtggtcttgttttgtctggcaatggccctcaacactgctccatcgtggctcgatgtagctgaaaacaaacgaagagaccgagccgagtctcaagccacctccgaggagctcgaatgagtccaattgatggatctcaccgacaagcaaaatgtctacttccggtacgcttggtagaacagtgtccaacacgccttggtagaaatacaatatacaatacattagttattacatgtttacgcgtccttgaactttttcatcggaggctcaaagtccgtgttttgatgtgggtgctgggggtgttgggggtgctgggggtgggggtgctgggggtgtagggggtgctgtacgtgctgaggaggctgggagtgttgggagtgctgtagatgctgtagatgctgtggaagctgtggaagctgtggatactgtacatgctgtggatactgtgagtactgtggatgcggtggaagctgtggatgctgtgtgtactgcggcatctgtgggtatcgatgctgcacatcttgcatctgattctgcgggtcgcccatacgctgaccgtcatccaacggcatatccatctctgaattcatctccgcttctggctcttcctcctcatggacctcgtcactggcttcactctgtagcatctgacgcacctgctggcaaatgaaagcgttccgctcagggtcgtcgtagttgtagttgaagtccaggaacgtatcagtaaactccaggcccgtggaaggcgcttgcatggaccgaatagcttgcttgttgagctccttcagcccaatttggccacctcgggcaggagcgtaaatcgcacatttcgcatcactcagagagtaggccatcttgatgaaccgtcgcaacgcagccatgagttgaacggtaacggcaaccgtagcgttggtgagctcgccagacttggagacagcagagttgagagaatgaacaatcatgtgggcatcttcaaccgtggacaactccaatgttgacagagctcgacacaggaaaaccaccgtccacaagcggttggtgatatcctcttcacttgtctgggtctcgtccagttccagagctcgggtcatgttcagaaaaagctttcttctggaagatctagaacccttaatgacgttgaaaaaccgatccagatagccacttccctgagcaagcttgggaccctgaagccgtcgcaagtagtctgcggcagctcctattccatccacataggtgccatcaatcaacgactcgtgtttctcgtgaaacaggcggtgaatactttgggccttagaagccactagagaaacgggactggcttccagagccacggtggtcgtcatcaaaagtcgaggattggcaaatccctgatgcgacaccttttccagcagcagaatggcactaatggagtgagcaccggtgccaagaactgcaatttgaagaatggaattgagataccgctgcacaatggacgcacagactccatcgttgacaaacttggatgtggttccgtgtaggactccgatatccacctgtccagaagcatccgtgttacctgcgcccttgaggcccgccttcgtcgccatttgctcctcgttctctaagaatgccgaaaactgcttcagaacgatattctgcagctcttcgtcgccttccagagccatatccagacacgaaatgactccaggaagcataaacagctgggggaagccaatgcacacggaaagcaggttacggacagaaagacgcacaatctcctgagacgcgagcttggggttgcagaagagaagaaacaagcctgcaatgaactcctcggacttttcgggcttacctgagacgtgaggtcccaacagtttctggaaaagagccttggcgtcgtcgaaattgcagtaccggccaagagtaccaaccaggtaaatgagacgcttaaatttcgggtctgctggtgcctccatcaactttcctgccttgagatgctgcacgtgcggcagaagtgccttgacgcaggataatgtggcggtctcgatcttcttggtatccttacgctttgaacaaacagcccagagacacggaacagccacagagagctccttaacgttgaactttgtgagcttcttgagcatggaagtttcaatatccttgagaagctcgtcggaaaactcaatgcgagacgaaacaacagcagtctcgaagattttgagcacgtggtacgtagacaggtctttaacatccgccgaaatgtatcctctcagtgacgtgagctggttctgagagatgaacaacacattggcctccacaaagtatcctagaagctccagatacgactcggtctggacaggattgtcgtctccaaccacatgcttgactagcagagaaatgtactgcgttccaacctgcaacgtggcttcgggaatgggatctttatgcaaaaacgggttgaaaatcgagtcgaggaagcgggctaggtactgggccagctgctcactcttcttcaaagtcgctaccatgctctgtgcatcttcaagcttggcaaccatgaaccacatttccttcagtgtggaggtcgccagttcttgcacggactcctcctcgtcctcggtacgatacagcagcttttcgataatctccaacttgacagagttgtcaacattagttgcatacaaatctcgaagaagccgcaagactcgcttacggactcctaaggacatgtctgacactcgctcgaacagggactcaaagtactgcgtagtcttggtgggttgtagcagcacatacttgcccacaatctccactgcggcgtctctgacagaagctgaggcgtcaacgagtcgagattttaacgaattggctacgaatgggagccgcataatcttgggatcgtaactcaacagagtggttagtgatttaagagctctgcttcggatttggattttcgattgctccaaagaatggcatatggtggccagaatggtattgtaggactctgcaagtggcatatgcaaaaggattcgagaaatgtcgttggcagaatcaagagaatcgttagttctagaagaaatctcatcggtcatgctcttggtcatgtccacgttctcagaacacgatgcagcaagccgaaagagcttcttttgtgccagttcaacaacatccttgtcttcattgtcatggtagccgcccaggatgttgccccattgggaaacaaagtatttgcgaacggtttcttggaacgggttgctagtttgcacgtcgttcaatgtacgaagaacgtaatgcgcggacatggcgagatgttgcaggtcttcgacaccttcctcgcgtgtgatcccagcctgttcgagacactttttgcgaaacgacagcacatggcacccaatagttcccagaatgtccatacagagtgtgagaacggcgacaggaggctgctgtttctctggagcagaaagaaagtcggaacacacgcgcacaaacgtgtgcagaatcagctcgccggaaatccagtccagttgaccgtacacgttaatgaaatcctcaacaaacaaatccagcagtgctctgtaaggcgactcgcttgattttgcggtcttggacgccttgtcgatgaggtaatgaacggcgttggttgcggaagagcgtgcgttggctgtagcttgttcacaggcctcttcaaattgcttgacagccggcgattcacgtgtcagcttagtgtttggatcaaaggtgaacttgtaacctccgcaggagccaatcaaacgcatcagaagagccgagacggtttggatcgacacgtttcccactctgaattgtcgtgcatgcgatttggtggagggtagtttctgcatggaggtcagaatctcgtccaaaatgaatccctgctggtcaggaaacgatgcaaacgtgacggcaagcacttccatagcagaagatcggaaagactcgacagcgaagggtgacagcatgtagattgagccttttccaccagtcgctgactccatgaacagaatcttgacagccatgaagaggatttttgtgatgatcgattcgtccagaggtcgcaggtatatggatttgcaaaacaggtcgagaaccctcatggtggtggcaactgtgctttccaaattctgtctccagctggctagttgcgaaccacactcctctgcggtcttgcccacagttggaagcagaagatgctctgtgatagtagacagatcctcggccacagacgagagaatgttctccgaaaacagctggttttcttgtcggggggagtttacgatccgtagtaccacgtctgctgctcggagcgagttggtggctgcctccaccagattagccatgtcacggtcgctcttttcagccagaggtatactcagatcaatggcattcatatgactgagagaccgggtgcagatccgttccagccgcagcagatcgtccagatcgaccttggcaaagaattcccggctaacagcccgtcgtagagtgtcctgtagctgcaataatgtcttggtgctaagaggcagaagggagcgcttgattggccgctgccagagattcttgtcgggaagagcgtcaaagtcgtagtcgtatgattctgctgagtcgtccgcctcgaagatttgctccagcagtcccatcattgacttttccaccatgtcctgcaccttttgtggtgtgagagatgccaccgtgtgtgttggaggaggggctcttggaggttgtggcggtgctggtggagttggcacattttgttgttgctgtggcggttgaccatgttggagtgactcctgtggcggttggccttgttgcagcgggtgctgggattccagcgtctgcgcctgggtctgcgcctgggtctgcgcctgcgcctgcgcctgcgcctgtgtctgcgcctgtgtctgagcctgtgtctgaacctgtgtctgagtctgcgactgagcctgcgactgagtctgtgtccacggttcctccgcgtccataaacgactgactgagcttggacactctgggggtggtgacatgttgggcagcctgatgcagaggcagccgttcggccagatatgtacttgacggactcagattcacaggaagacgggagccggtctgctcgggctcaccgtcggcctttccaatgcccaacacgtactcgtcgcccttgaaccgcagatagctcatgtcctgctggaacagcgccgtggttgtctgcaacagcagccggttggtgaagtcctcgttggccccaggctggttcaccgcagcggcaatccgctcggcgcgatgggacacgtcagcgggatactcctccagcaccacgggaatggttgtgtggattcgcggaacaggcacatgtgctgtgttagtctagtttggggagatcagcgggcccatgctactcaccttttccgaccggcatgaacggcatcagaggactgtacttgagcgcgtcgcccgccgtttgcggcagcggtttggacggctttggcgagttgttcaggtcgaccatatcgaatcggagcggatgtgagactgctgtaatgctgatttcgtgtacctgtgaaccttgtcaataggtggatgctgtcaccagaaccggtactagaacagcaagtatatgccgcaatggaggcggtataagaaggatgaaacagtagacaaagtcagagaggttttggcgtattggaacattctggagtcgcgaatcacgttggaattaggctggtgaggaggtgttaggaggtttggttttagttgatgtttagttaaagtggaagggagcctcagtacgcagttgaatttaagtagtgaaatatttcgtctcagttgaagtttgatgtggtgaaaaatttcgtctcagtcgaagtttgacctgatgaatggttggtgaaatgtttggtgaaaatcaactaaaacacgaaaagtgatgataaaatagaataaaaatcacttcaagtgattcttagagacattttgattagtcatccattcattccagtgcagctgacagcagcatggtacatactcctgccaacatgccggttgaggcaatactgaaatcaaagtcaacaaacacattggtcaaatttcaacaattctcttctaaaatatcaacaaactttagttaatctcaaaccccaagacacacaattacacaataaaaatgtactgtaagggatacttctttggacatttttgttgaaaacaaatatcttttcaaactaatggtctaattttaaatttcttacaattcctccaacagcgaatttgaacccccagctcaacttttgttttaacaaattcccaacaaatgtcaactaatttctccccctgcatttgtctaccccggttcatcaattccgtcacgaaacgacgaaaaaattaaatcaattcacgacttgattcatgatatccaacttatctgtacttttacatgtcttcgcacgctttcaccgctttttcaggagctcgcgtcttcactagactctcccccttcacacataaagttgactcctacatccgataatgctgtgatgcatacacctgtaacaaaccacgcaacatcacacaactcaccatgaccagcacggaaacggcagcttctctcgaccatctggttcgccaggtgctgcttcccgacagcgagccgtccaagcccgttctggagcttttgccggtgcccacgtcgtgttccgatgccgtcaacacccagtggtacgctctggcggcgctcatctgtcgccacatggtacaatcgtggtactcgcggatttccgacgaccctggctttgtgacggagatggtggaagtgcttgctaagatctcgcgggatgtggacacccggctgcagacaattgactacgagacggcgctcctggacgggcttccgtacctgattgattcgcatttcgaggcagtggaccgggccaaggcattgcagggctcggcgtttcttccagtcaactcgctttccgagggtctgcgggtgtttcgaccccatagagctatttccggagtccctgacgaccactcggagctggtgtaccaaaagctactggcgcaacagatcacaacaattctcctgaaacgacagaagattgacagcaaggtggcacacgccttcatctcggcgatcctgcacgacgtggtgctcaccaccctctttgagcggctctcggaaccctggatgctctatgagatcatcatcaaggtgtgcgacctgctgcctgacaacagcaagacccccgaaaagaacgacaatggcggcggcagagtggtggaaacactgggatacctggtgtctaacggcgtcactattgctacagaaaccttttacgcagccagaacgtatgtcagatcagggttcgacttttacgagaagaattcagtcgacccaacactggcggaccaacaagacgaaggcgacagcgacaaggagaaggaaaacgagaggaaaacgagaattgcgcccaaaccagtcacatcgagatactttttccaactactggtgaacatcagcaacattcgcgcaaagaaaccgctgctggccagcaccctgtcctatctgtctgtattcctggagatgcagccgctggcggtgtcgattcgaaacgtggtggttaactccatgaacaagcacgttttgcgtgaaaagactgccgaactcattctcagaagcgcccggaccaccttgttccccaacaacgggcctatgggagctcccagggtgcttcctacggtgctggaacagtacgacattcgccagaatgcccgagatgccctatcgcgcgtattcccgccgtttgtggggaacgtgaccacagacatcgatctttggctggaccacctgagcaacaaggaggtcaacaagctgctgctttattatctgtgcgattacttgttgcagctggcttttcccgagctgtctgaaaaggtggagtagccgacctgggaacgattatttattgggggaacagacctcttgtatacaaatatatctgaaaaagtaggaggaggagttgatatgttcccacaattccaatctgatttcaattgaggtctaaatccgtcttttttttttcccaacctggactgcgatctggagtcgtgtctggctctgagtcgcacttgctcgcacaattacccgctgctcaagcagctggatgagaatggaacgctccaaggcaacgtgcaaccacgggtgccgtggttccacctcggtgattcgggagcccaaacaggtctcaatgcgccatgattattgtttcgcggaccgcgagaaggctggatcttgccaacgagaacctgtacctttggaaagacttttacgcaaccgttgctctgggcagaaacgacgtggagatagtcgagtactacatggagctgaggatgaacgacggcatatgcgcaccaatttgcagccactgtttgagggtgaacttgcggctctatgttcgataacggcgaggttctgggcacgaatctcgctgttccagcaacccaggtcgacttgagaaacgtggtcacctccaggcccgactatgaggatcgcaatggtggaccccgaacaaacgtacacgtggttgtgtgtcaccttcgggcctggtggttgaaatcgatgacatcacgggtggtctacgtcaattacgaaacgacaagctacaagtactgtatatactgtgctgttgtaagcctgttgtttggcgcccaggggctctaatgctcgtcagcacgtatactactggttgtcgtcagatatgggctgcgtggaacctgaggttttacaggcttcctgccgttctcatttgctcggtccccacgccatgtcatcaagtgactcggtattacggttactgtttcgttcttcaatggtcgcttctatcgactctgggtgacccgggataccgcgatgatctgtctgagactttgaaaatggactatctattggctgaatgtgctcgatcgatgccgaacagtctgagaccacttcactgccactcagatcgctcgagagagggcttttgtcagccactcatcaagctgtggggggaggggttggagacatgaagacagacaagtcgtaccattgcaggaaggacaatcttctgattttgatgccctacgtcagtaacggcaagcttcagtttgcaggacttggacaagtgtatctacagccctggcgcgcgctatggaacgtggacctttgggcactcatctaacagaactgtgtcgatggctgaatgtcgaggaagcggcacgaggggaaccctagagatgagtagatcctagaagtgcttgagagatgatcccaaacaatctgaagtgagatatgttggcagtgagcataatgattgcgatgacggcttggaaggcgatgaagaggagcccaagctgtacctcaaccgttggggatttcgtctggtcgacctttatgttcgcagagagcgtaatgatcgggatgagagaaaggaaggatgtgtggaccttgttgcccgagaacctcctctgctcccaggatcgtggattgtccgcaggcgtccaagagcgtcgattacatggacgaccgagtcatgttccactggagcaagtccgcgcaacttccagctcatagtatgtacatactgcacttgtacttgtaaacatctactagctaacatgattgataagcgtttctggacttgtccgccccagctatcgtaatttcgtatcgtaaaatcgggttgggacgactctagggccatccagttctcctgcactatcactcactgggaactttatctccacatcacacctcaccaacaccacccatggaggaactacgagctcttatcaaagcgcaaccgcggccgctatcgcctcgaatcgtccacgacctggttcagcaggcgctcacgtcccgacacattttttcgtttggcgaattgctcgacttggacgagattagcaacggtcggcaagacgacccgtggatccagacgctgcgaatctttgcgtacggcacgtggtccgactacgtggcgcagaaggagcccgcaaacctgccggatctcacagaaaaacaggcaaccaaactccgacagctgtccatcatctcgctcatcacagacgaccccagcgtgcagcaggagggcattctcaagtaccacgacattgagaaggcggtggggctaggcgaggagagccagctggaggatctcgctattgactgcatttaccgaggtctgttccagggccgaatcaactcgcaactgcatctggtggaggagtgtcggttgggcaatgtggaaagagacgtgtctcccgcacaggcggtggagattgaggctgcgctgacggagctgctcaatcgtagccagaacgtgctggatgagctggaggaaagcatcaagcaggttgagcatgacgcacacgagcgaaacttgtcggtgcagaaatacaaccaactgctcaagacgaaacccaagcctgcggtatcgaaaacgaagtcttaacggtggctaggagtgggttcggtcatacccaatgcgatttgtccgtcgtcatggcggtcacatagtcaactaatttatcagcagatttgaacaaacgacaacttggagacagatagagacaacttgacaacagaaacgtcggttgctgagagaaatgtggtcggttgcttccatggcatttcaatgtcgctattctttcactcctgtcactacttgcaactacaagtccatattggggaaactgtaatgtctgtatctcgatgagatcaagatatgaacgagtatcagatcataaatgtgtatacaagtaaaataacttgcaatataagtacaagtattcttactgtataaatagaaaacattgttgccgccaaatatgtcgtttgctagctcctttcctcttggtgttcgttctcgtgcaaaccatcggtgatagtgcatgaagagtgtttacacaggttaaatggacagaatatagagaatcatattggcagtgaattggggaaataaatactgtacaagtacttctagtacttgtagctgcaccggatactacacggggcttagctattacattgtacaacatactactggagtgcagacatgaccgctgacacaaatgaggctcattcacctctgacgttttattcacattagcttaagcgttccagatcttcttgatggttccggtgaggccgacatcctcagtctcgagcttgtagagaccgtagagaccaaccacggttcctccgtacagcaggtacatggcgtagttgtgaatggagccgtagactcgcttggggatgtagtcggtaatgcaagactcgaaaccaagctgagagtggatcaggagagtagcaccgagagtggcgtccagaacgggggagatggagccggtggcgaagggcagcacggtcatggggatgaggccgacgacaaggattcgctcaaaggtccagtggtaggagcccttggtggggttggcggggggaacgggggcggcgtcgttgacggtgccgacaatgcctccgggaggctgggggatggtgccgaacatcttgtggtttcgcatggcgatgggagatcgcatcatgagctggggggtcatgccggccttgaaggcgggggtggacagtcggagggtggatctgagcatctgggttagtatgtgggagggaaggggggtcagggtggttggccaggtggacaaaagtctgtcctcgtgtgtaggtgaaagtcttcctagtgtgtaggtggacctagtgtaggcgaacaaaacgtgaacggagtggcatgacagagtgacaagacagagcgacaagacagagcgacaagacagagcgacgagaatccgcgaaagacattaatacaaagcagacaccacgagcagcgtcacaagtagcgatcttctcaaatgtcgtcaattcgcgaccaagctaagatacagatacccattgctgctagtgtcgcgcgccgtgtccccacactgatgccccacacagggatgcgcgtggtggctgagaacagcagtttgtgccgcaccatttgtgtcacactgtcgatggcgttgttttaaacagatcgcttgttgtcccattgcttgtcccgtcgctcgcccgagccctgtggtgtgttatgtcatggtatcacgttcagtcgtcacattccgctgttcagggggcgcagttttgccgtcgtgtgtgtgcactatataagcgccgtgtttcccatcttgttccttctctgtttcatcctccttgtccatttcgtactcactgtgatgtgcgtgttgtgtggttagctggcagagctcagtttcaggtagagatgtttccccggtctttatcgtatagtgcgctgagtaagcttcttttggggggcattttgcctccattacggaaacgttaaataatggaacgcctcctattggctgctgggacgggaccagggacttttccggttggacgaatgacaaagcttgtttagtgagatgaatgaaggatgaaggcacgtacaagctggatcaggtgagagacgagagcggggggagggatggggggttggtcacgtgacccctcgctatcacgaatatttggatgcgaaatatggcgaaaagacactttgagaggagaccggctagcggctttatttcctgactcaccataacccttgccaatcttcgactaagactgtgggggcggtgtggtacggatattgagggagtacatcgtataccagaaaaagagcagacagaatacgatcgtagtgtgaaactagacagcactatcagaactcctatcttttaattattctggccaactcagaacaaagaataaccgtgtcgtctcaagaaaacgtgcacatttcaaaattaactaaaaaaaggctttgataaataagaggtggtccagcagaaagactcatattaactttcaaggatttaaccacacatagtatcatattcgaataggtaatgatggcacccacacgaatgcctatttcaggtcttatatttataaccatgagcgaaaaagccggggtaataaataactttcccccaaccagtatcgcaaccatataaattcttaaattcaatttggcaaaaaagccaactggaaattcctcgccacgtgtgaagaaacataaaaagaggccagaaaatttttggatcgggtccgattaaacaataaaatattaaaaatttggctacacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagagacgaggatgggagagggggagcaggcgacactccaacagaaacaacgtgtaagaacccggaacgagcaattacagagaccatgcgcaggattccccgccctcacagttctagacgtagaaaaggcgcagcagcctactcggagacttcactctaacatctacatcacgaagtgccgataccgggactacaacatgacggataggaaatagcacatattgttgatgcatcagggcaaccatctattttgtatgttaattctattttagttacattctacactcactcattttggtgaaagaatatataagtatcataatatcggatggtaccttgtatgcaatatcggcaaagcacgatcaacacattggacatactacacaacgtaaaggcaagaagaagcgtgatatgaacagcgacttgtcgggcgtgcccagggtcccacccccatcctggaacaccaacggcacctcacaccccaaaagaataataataaaagaacatttagcagctgatttaaaaatcggactgatactcacaactcctacaatcacacgaacgcatctcacttgccactacgcccccaccccctcgctttgaacacccgctcagactaggggggggcagtaatgaaccctactattaggcaaacactcataatggcattaagttaggacagctggagactacacccaaaaaacaacaatcgcactccaacacgacacgtcgtacccaactcaaataataacaagagacatcgtttctttcttatttctacaagcgctcgtgtggtgttcccccccccccaatcaagggtgccgacagcgcaaagaaaaaaaaatagcacacccactancccaacanctccnttttnnannnnnnccctnnnctttctggttcttgctggttcgtgcagagtcgaacttaaccccaatgacccgcaatcgcccccaaccaacgcgagccggggggggcgagggggggcgaggggtcacgtgaccaaccccccatccctccccccgctctcgtctctcacctgatccagcttgtacgtgccttcatccttcattcatctcactaaacaagctttgtcattcgtccaaccggaaaagtccctggtcccgtcccagcagccaataggaggcgttccattatttaacgtttccctaacggcgcctagccccccctcgccccccctcgctccccccggtatgtgtttattgtgcgcaattgctgttcaattggcttaagcgcgactctgcttgtaccagtcttctactgacaataatttgtcactaccaagtgcctactatacagtaaataagcttccaaggaaaagtgatttgacgtgcggtacagcagacgagggttgtgtggggcggtgtagagcgggttttttgacattgcggggccgggagaagcggtatatatagagcagggtggtcgtggggcggaatggaggggccagggccaggattcggcgatttgtagccagtgctacccacctcgtccgccgccaatgagaaacgcgggaaagcaaaatagggttggttgggagcaatctgaccactcacagggcgggaaaaatgtgcatcatgtctgagggaaagtggcttcaccttaacacgcactctctattgcacccgtccgagtagtctctctctcgcatcgatcgaacgacccccttttctctacttgtcgcacaacacggcgtagcaattgaaagaccacagatccaaccgacaccatgaactctcttctgcgactgcccgccctcaagcgaggtgtcttcaccatgtccaagcgaggtcttgccaccacggtttcccccaagactcgaacctccaacctcaagaacggactgaccattgcctccgagtccaaccctctggtgcagaccgccaccgtgggcgtgtggatcgacgccggctcgcgaaacgagaacgcctacaacaacggaaccgcccatttcttcgagcatctggccttcaagggcaccgacaagcgatcccagcaccagctcgagctcgacattgagaacatgggcggccacctcaacgcctacacctcgcgagagtccaccgtctactacgccaagtcgttcaaggacgacgtgcccaagtcggtggagatcctcgccgacattctgcagcactccaagctggccgagtctgccattgaccgagaacgagaggtcatcacccgggagctcgaggaggtcaacaagcagtacgaggaggttgtcttcgaccacctgcacgccaccgccttcatgaaccagcccctgggccgaaccatcctgggcccccgagagaacatccagaccatcaccaacaccgagctgcgaaagttcatcaccgagaactacaccgccgaccgaatggtcctggtcggagccggagccgtcgaccacgacgccctcgtcgagctcgccgagaagtacttctcccacctgccctcttcccagtctcccgttcccctcggtaccccccgatcttctggtgaggacgccaaccagaaccccatccccaactttgtgggatccgaggtccgactccgagacgacaccatgcccgtggcccacattgccattgccgtcgagggtgtctcttggacctccgaggactactacactgccctggtcgcccaggccatcatcggcaactacgaccgagccgtcggcacctcccgacaccagggctctcgtctctccaacattgtgtctgagaacaacctggccaactctttccagtccttctccacttcttactccgacaccggtctgtggggtatctacctgacctccgagaacaccactcagattgacgatctcgtccactttactctcaaggagtggaaccgactgtccacctctgtgtccaacctgcaggttgagcgagccaagtcccagctcaaggccggtctccttctgtctctggacggcaccacctacgttgccgaggacattggacgacagctcaccaccctgggccgacgagtcacccccgctgaggtcgaggccaagctcgaggccgtcaccgagcacgacgtccgagcctgggcccagaagactctctacgacaaggatattgctctggtcggactgggtcctatcgagggtctctacgattacaaccgaatccgaaacgacatgagcatgatgagatggtaattgttcccgtctttgcatatagcctggaggcgtaataaaatagtcagaaagacttggaggacattgtcgcagaacgactgtcaccgatcaggaagaatgtagcatgggttgtgaagcaccatcaggatattggagtgtagtggactttgtgagtaggggtacgtcggttaccgtctccaggaccatatctagttagactggagtcttctacgaagtacaggtgattgcctgtttggcgcagttagctacggcataattacataccaatgtatatgctggaggtctacaagatcgtgagtacaagcaggtgcaagtagaagttgtttctgggtacattctggcttcaaaggcgttatggctccagtatttgaaaggagaacataccaacgctgatacttcctttatccaagtcaacaagaaaggtttttatttattaaatactacaaattctagaaatattgaacaaactgatcagctttgggcacgttgaacaagtagacggggtgggccgatctcggacagttgagaaataatgagaaaaacattgtaaagggagtatcattggaatcagagaagatgttcacagcgaatggtgtactattaccatccacaatggtagagtggctaacccaaggtcggtttataccaaatttgagaaatgatatagaacagacaagaaaggtttcaaggcgacagaagaagttgaacatgtacattatatcaaaaaatcaaccaggaaatgtctttaaaaaaatgtcttcatatgtcttcatatccaagtctcaattgctgattgagctggattatgttgggttgaagcaagtacatgttcttgtagagtgctacagaacgaacaatggccaagctgatctcgatgatagtcattattctacaaaaaggtctgaaaatacgcttgtggatcgttttatacaaataaactcgatttatgaataggaaggatgagtaatttgatttaatgagctcttttattccgttttgggctcattttatgtttccgttcagcttcttccacaggtggacctctgatggaagcatttgtagatcaagcagagggttgtataagtccgggagagatggcgtttttaatgatagatacagtcgaggaggtaaaagaccgtcatcaacaaccaactatccctccaccccaacttttgcttttctacaacagtaacttatctcaacagtttgacaatgctcttaactaaaaccaactaatgctggaacacactcaacgcctgacaggacatggaacgacatttgttatgtacaaaaatcgtaggtgttgtactatatcgccacctttactttctctgtccctgtaagatattttgtaaacatttatttcaaagttttgatctctagatcatctcttacggatctacagtatctttccgcttaactaatacttgactaaagtaaagtgccattgaggtcagcacaactacagtatatcacatcaatacttatgatcttcaatatccaagaccacctccaacaattgatgttcctgaaaccaggaaggagttgtaaatggtgtgaaaagtacccgtgcaaacaagcaacggcgagtgtatcgctgattcagtcctcaacagacatccaacaaaaaacatcttcagaagggatcaagaagactacagtaatacagcatgacagtataacggcattatggcggtttggcatattgatattcacagtattcacaaatatactatacaaatatgctgtatcggaattattcatacagggtgatattggcgtgatttgatcctcggtataagatatgttatatgtactgaacagtatgtacttgtttttgttcattattctggtttgttgttcattattctggtttcttttgttttgtctagatcattattctggtttgttgttcattattctgttttgttttgttttgtctagatttttttgtatgtacaaaaattatttttttaaaataaaaatctcaacagatctaagaatactctacattggccattcgtcaacttgacgacgcaaactaggacaaaaaaacccattggatatatattgccaacacccgtcgtcccacagttacaagtaaatcaatgaatcaaccaatttcccattgctttgccacggaatatcgtcacaatgctttcactaaggttccataatatatataaatatataaaaacgcacgataatctccgaaaagcagaaccgagcaaaatttagtatgtactgtaagactgaaatcccgaacatcccaagataccacacaagaacgacaaaaacaacccaattgaacagatatacacatgtccccggcggtttggcgtcccctgaatctgtctctcctgtcaccattgccatatccgtcaaacccaaacgtcgcatgatgaatgtcttagtcatgggcgagtacatactgtatcagtatcacttgtctataactatggtgcaacatactgtagtgcaaatactgtccatactgtatctactcgtacctactcatacaactagtactgtacaacgactcacactttgtcgttcagaggagactgtccatcagctaatcaactgcccgtctgctcccactctgctcgagtcacgtgacgccatctgcaccgcctggcttgactgcactagtttagctgtggcgtcaacaaacaaaccaaccagagacagaggagctggacaagggacggccgctcgaccaatcggagggtttcttttgatatggtgtttttgcgatggtgtttttgtggtgttttgagggggtttttgtggtgtttttgtggtgtttttgtggtgtttttgtggtgtttttgtgatgtttttttgagagtaatttttattttttattttaatgttttttggataggtgttttggcgtctttgttccactgtacatgagccctctcgtatcgtgcttcatggtgccttcaaagtggtttgttgaaacagattatgagtccgggacgcaaacgtagtaaaggccagaaataccgccgcgcaagaccgactgcagacggtgcatctcttctgccgctgcgccgtggtctgtggttgccacttccagcatcacataccccacataatcggcaatctgcacaccaaagttagtgtgcaaagtgggttgaacatttttgtctgatctcaacctccctcacacaacacactaccacaactaactagctacacagattgctctacaggctgagcccatgacaggtgagtagggacacgcggaacgacttccggagctgctgctgactcagaatgaaaaaccggctgtatggactgattgccttgttgggctggggagcgtcgttgggcgcttcggacaacaacaaccaccacaaccatcacaacaacatgaacaatgtgggcatcgtcgccaacgtggcgcccaatgtggcgtacgaggtgacggcccacgcggaccccagtcacgtggtcgaacagagcacagacgcaatacacaccgctcgcgcattgaaggaatgggagctcagcgacatcatcctcgttgcaacgatagacggcggactctatgcgcgggatagagccacgggaacagaggtgtggagcgtgacgggaaacggcccgttggtcaaggtgtttgagcaccaggacgagtacgaggagaatgtcacttgggtggtggagccactgggagagggcactctcttctacttcacacagacagacggcatgcgcccagctgccgctttcgatcgaaaagctggtccaggagtcgccctttgcgctcgacggcaaggtgtacacaggcacccgcaaaaccactctgtttgccatcgacacacagacaggcgaaatcgtacagagctttggaggcgacctgtcgggggtccgaacggagcgggaagacgagcccgagtacggctccaatgcgtccggagtcatcatgatcggacgaacacagtacgatctgtccatctatcgtcagggtgcgtcagtgtggaatgtgacatattctacatgggggcccaacaacagagacattgatctggcccgacaacactcggtatcaatggacaacttgtatgtgacgccgtttcacgaaaagctgcttgttggcgtggaaaccactctgggatacagacctcattgggagacgtacatcccgagctgtgtcatcaacgtctttgacattctaaaggacaagcggggtgcaagtgacgatggacatggacaagacgtttccaacgtgctgctcccccagccacgggtcgaggctcctcaaaacggccatgttcctgccatctacgtgcaccaagcagcggatggcggcttctttgccatctccgagcactacttcccgtatctcgtcaagtctgctcctttgtcaaagtggtccacgtcgtcgtacagttcatatcccaaggatcggtttgcacaaaacctcgcggatatcatttgtggcgtgcacgactcgtactacatggtgcgacgagtgagtcccgacaaggacgaaatgctgctgttgaaccccgcaggtagtcaggcgctgattgagggtcaacgatatgacggtgtgagggacggcatgtctcctcggtacggcaaggagggccagcagcagggagacaaacgtggagacagcggcgattctactactgcgggtttcaccttgttgtcgcttttgctgccgcttctcgagagtcccattaccgctctcttgctgcggatagtggagaacattctcaccgtggtggtcattctgggcattgtctatgctgcgatccggtttgattttgtgcctcctcaggtgaaggagattattgacgctatttcagctcttagaaagggtgctgcaagggaagtgggggagaaagactcagtggagaaggaggataaggtggagaaggtggagagggaggagaaggaacaaaagaaagataacgctacgattgtgttagacaaggtagatgtgaaggacaaggtggatgaaattgtggtggacaagatggatgtgagagaagaactgaaggaaggggccgtggacgagacaaaggtggacgagacgatggaggagacgaaggaagcaacgaaggacgaaacaaaggacgaaacgaaggacgaaacgaaggacgaaacgaaggaagagacgaaggacgagacaaaggacgtcaatggtgtcgacgtggagaaaacagaagaaaagttttccaaggaggtcgtgagcgaagtcaatgctgttgaaaacaactcagcagaaaacgacagtagcgatctacaacctctaacctctgacgacaccccttccgctgacactctgtcgaccccttcgacccccaaggtcaagtttggggacgtgtctgtggttgctgacaagaacaacagcgatagcgaatcggaggagtcgaatctggccgagtccataacctctctcaacggctctagtctctccaagtcgtcttccaccgcgtcaatcacaggcatgacgcccaagaagcggaagagaggcagtcgtggaggccgacgaaaccagaagaacaaggaagtaccttctacggctgcggatggagtcatcacttcgccaaactctgccgccgacctcacacaggttgcagcagaaaagtccgggcccattgtcattgacaactcaatccagacgctctcgcagccagtctccgagcaggccgacgacattcagttccagagctcagtgctagtggtctccaaggagattattggcaagggtagtcatggaacaattgtgtacaagggtacgtttgagaatcgggaggttgcggtcaagagaatgctggtggacaattacgacgtggcatctcatgaggtttctctcctacaagaatcggacgaccatcccaacgtgatccgctactactgcaaacagcaaaacaatcattttctgtacattgcgttggagtggtgtcccggcactctggaggatgtgtttgaagactcgagcgacaagttccctggcgtcaaggagaatatgaaccacgtgacggtgttggagcagattgccgagggcgtcaagtacctgcactctctcaagattgtgcatagagatatcaagcctcagaatattctggtagcccctgtgaagaagcggcgtgcaaagaaggccaacccggacgacaagtatgctgtgcgcatgctaatttcggactttggcctgtgcaagcggctggagaacgaccagtcgagtttccgcgccactaccgccaacggaggagcaggcacttctggctggcgggctcccgaggtgctcaatgacgattccaaccgacgagccacgcgggcacttgacattttctctctcggatgtgtgttcttctacgtacttacaggcggtagtcatccgtttggagaccggtacctcaaggagagcaacattatccggggcatttacaatctggacgctttggacgaggccattcctcacttggcagttgaggctcgcgacctcatcacccatatgatctgcagagacccgtccaagcgcccctcagccgaggaggtgtgtcgacacccgctgttttggaaccacaaggagcagctggattttctgctggaggtgtctgatcggtttgaaatcgagccgcgggatcctccgtcggaactgctgatgcagctagagcgggacgcgccgtcagtcgtgggctccaactggcaggagcagctggatcctctgctgctcgaaaatcttggcaagtaccgaaagtaccatggcgaccgggtcatggatctgttgcgggcgttccgaaacaagtaccaccatttcaacgacatgccgccggagctgcagaagctcatgtctccgctgcccaaggggtacatggagtactttaccagccggttccctaacctgttgatgagtatctactacgttgtcaaggacaatctgcgtcacgagcacgcgtttgagcggttttttgaggatcattagggagacggaggggattagcatttgcggtggatgtccacgcgcattatatagcatgaaaataagttatagtgagtagagtagagtatggagatggggctacagtacagtacactacactgtatcactcttgacatattgtagcattctgttgaagaatcagtctagtagatacgacttgtagttctttacttggtactagttagagaaagaagtagaagaaaagctgggttaagtagatactagtaacagttgaagtgtaccaaaacagtaaaagtgtaccagaacaaaagaagtggacttcttttataccaacaaaatccctttcatactcctgacccagccttgcctgtattgctagtaccaacccaagatgatactgtttcccctcgctaaatctctcaaccacaactttctgcacaactctaaagcattgtgttaaataaacgacagtaccacgggtcgtctttagggcgtgaggaagtggattgatttggctgaaaatttgacagaccgatccaatcaggattcagattgatattttcaagtctccgctactttttgtctctcctgggtcccgaaaaatgcccccttctcccccccacagcaactctaagctgcataaacacatcgatatacattctcttggcgcaaccgtaagggaggaccatcttccagatcttcgagatatcgcttcgctatggcctcgatagacacgtcgacgtcctccggcggcgatgaaaaggtgcgcgaacacccctacaagcgcacgttgacgggccacgccttgccatacaaccgggcgtacccgaaccgtcctgagggccgagccaaacagccgtttctgcgccactacttccgccctagctgggtcgtggaccacctggactttgccagcttcaaagtcgcgtcgcgaacgtgggtgggaatctggttcggactcatgctgatgatgattccgggctacgtcaagtggctgggtcgagcgccgtacctgacggccattatcggcgtcattgtgccgtctggagacatgtcggtgacggtgtgcttcatagtcaacgcgggaatgatgctcttcaccgtctttggctggatcgtcatgatcgtggccatgtacatcaacaacaagtacttccatgacagcatgacacccaagcaaatgacccagattctgatcgaaagaggcatctgtaaggcccccaccgatcccaccgaccccaaggccatggcagctctccaaacctgtgcccagggagccgtatttgacgcgcagttcatgacagcaaagggaagtatcgtctacgccgtgctcatgggctgctttgccttctttctgctgtgggtcaagaacaagtcgcgaatcatcattccgggctacgtttgcggcatcatcgccatgtctgttcttctgactgtgggtcccatggtgccttattaccaacccatcactctaggagtggtcctcctgaaacccgtgggtcttcaatgtgccatcaacttcagtctttcggtgctgattttccccttcaccacagggtttcagttcaccaagacggtgattggcgaaatctccgttctttccggtctcgtcgacttccaccagcagtttctcggctccagtcttccgtccaacgagtccgagtggctcaagttctccgagattgaggccgacgtgaccaaggcccgccagctgtatccgaaaatgcagtccgagagcgcaatgttgcatctggagctctcctttgcacgcttctgtcaccaccactacgaaggtctcaaggtggcagtaggacggcttacctcttccatggcgggcctggtctacttttacgacaacattgaaaacatccgacgagccatcatcatcagtgcagaggcagacgaggcgatccgagcagttccctcgcaggaagagtctgagacggtgccgccggtgggcgtgtacgaaatgaagagtggtctacgaaatcgaaccgccctgcaacaaaaggccaccctcagagagctcaccatgcaagacctggacctgctcattctacagctgcgacaaatgtcaactccgttcattcaggaggtctgcaagtcgctggatgtgataaagcggtggctcgaggccgccaacgtgtaccgaggcaactcgctcttcttcttctggatgtccaagagcttcaaacagcagcagaagcagctctccgaagagctccgcgaacggtatgcggactttcagcgtgaatccaaggacctgctggaatcgaaacggtttgctctgtttggagaacacgaggaaaacaccaagtttgtcaccttcttcttccagggcgctctgtactgtggatacatgaagaatctgtctgacagtctggactttttatacaagatcctgctggatatcgacgaaaagcacgccacgccctcgtggagatttggaaagggcatcaaaaaagccaaggacaacaaggccgctctttacattatgaaccattacgcacgagccgacgagaatcatctgaaaacaacccacaacgaagacttggacgacctgttcaaccagacaatccattatgccaccgaccgacgacgaaaccccgatgcaatgccgccctcgacgcctctacacaagtttggagcacgatttcgcaaggagattatcaaactaggatcgcctagtctgtttgttcctctcaagggagccgttttcaccgtgctgtcggcctctccgtgtttcttcacggcctcagccccctggttctacaagaacaaaatcatgtggatggtgattatgacgggtctgtccatctcggagaacatggctgacaatctctacggcttcattgctcgtatcttgtactccttctacgccggagtcattgccatggtggcttggtacattagtacaggcaacggcaacggcaaccgagctggattcatggtggttatttgcattctgtactttgctttgtcttactaccgggagtttgcccagcacaccacccccatgcccaccattgtcctggtggtcactacggtgatcattctgggcctgtcttggacagacggaatgggcatcactacccccactatcggtgtcggttatgcggttgcatggaaacggtttgtgaccgtggtcatgggtcttacggtgggatttgtgtgttcgtgcgtgcctcgtcccgtgacgggaaagcggctcattcgaaagacgctcgccagtatcatcaaggacaccggcacattgttttgtcgaatcagcgactttggagctactcgactcgccaaccccgatattgaagtcaatagctcgtctatcaatgatcccattttcggcgctatttccaacggccagagccgaattgcgggcactcggttcctggcttccatgatccagtttgaaccatcgctgcaaggaagatggccatccaagacatacagagaagtcaccaacattgtatctgaactagtggagctgcaccaccatctctacgttgttctacagcagattggagagcccagatactggctgccccatctcctgaagctcgtgggatggaagaaccagccgctcatgtcgcactactttgccgttctgtacatggcccagggagctctctacgacggctcaccacttccccaggtcactccagctatgcttatggtagagcatttggagattctggagcgacagttcaagaacacctacgatacgactgccagagaagccatgggagacacctcagacatggctagcgatgacggaactccgggtctcgaacaaatctctttgcagcgattgaagacgactgacggactctacttttcagccagcattgtgctttccaactgtatctttgaccgaatggatcgactcatgttccaggtcaagactcttgttggagagcagtttgtgaatgcagactactatcgcgacgatgaggtggtttgatgaggtagtcgatccgcttctagcgtctattggcatacttgactaaaatatttatttatagagaatacattgttaatactgggatgtacagtatactatggacatgctgttacttggagtagtgtatcagtacgaggagtacatgtacagtgccagtatggcattgatagaggtactccaactcgttcgtactagtacctaccgtacaactacgactgtagcattaccaatgctgtaattatatcaacgatatactgctatgcactgattcctatgttctactgtcactgtagtctcaccctggttatatatagaacataattagacaaaaaaagacccaaaatggttcttgagcgatgctgtcttggttggaagttgctgaaatcacgtgactcgaatttccatgcgaaaaatagaccacatcacatagttttattttcttttttcataatgaagtatgttaccgctttgggaaggcggagccggagcagtgaaatttcaaatgtacgaatacaaccaagcgtacaagtttcatattgtagacaatcggctagaacttgttgtatttcgcctttgtcatcggtttttgtgattcttgcggtgattagatcatgttaatcaagtactgtacgaaaatagacccttccattaccgaaaaagtcggtccgatcaccgttctctacgtacaggagaccctacctaagacaatgcacatgggtgatgccgaggctgtattgattgcttgaaagaggtataaatcggagtgtgaactctgaggttggtaatcgagagcaattcgggattggaggtctccggttgtgtggtagagtacgatatggtgagtacgatatgattatgtacggtatgatagagtaagacatggaaatacgatatgtattcccatggattgtaagcgtagctagtaataggttcatgaatagatcaatagcggcttgtagcgggcttgtacgttcaacacttccgtactgtacctgttctacttcgcctttctcagtcttactgtcccgggaaaaaagatccggtggaaagtgaagggtaaactagccagcgatgaaacaagaaccgcgctaggcaggtcaccagaatggattgattattcgcttctataacctcgtacttctccttctggctggcctaataaagacttggcaagactgactgcacggtacagtacgcgcttatctgatgcttcgggttcttgtcgggaagatcaactcttgtatagagcgcactgtaccgaatcttcagttgcaggtgttggaaacgcgagtctccccagccagatcgagtcggacccggagctctgaaagcaattctagagtcaatgggccgttatcagatcagatgggttgtgttcgggtgcacggcactgcaaatgccggtatattggctgcgtgagtccttggcactcttgatcttggcacaggttatttcttggcaggaggaagacagaaggggagaatggactgattctggaatcacgatgtatcatcggggttgtctatctcacactactgtatgtacttgtactactgtaccgtcgttgtgtctacatggacctcttgatctacgttccagcgtcgaactccgttccattctcaccttgcagaactttttcaatgagtgacatctacaaccaccgtatgtacgagtagaagaattctcttcatccgcttgaacaaacctattacagcaaagtttcagcaatgtggaggacaagcgatctgataatctgatgatacatgcattgtaccgtaccaactgggatctgttgctctacggcaatcttctgaaatgattgaaacgagttacgcaaccagctcgaaggacaactggcaacaatgggccgtggtcagaagcaccccggcgaaaaacaagcaataaaatcatgcgtattcgctcccacaactttttcaccttcggaacgctaaatcgttatacagtatgtactgtacgtcaaatcgggaggttaactttacgagagcttctggacagacggagcagtggagcagataggggttgtgggacgatttctcaagggaatgatacatcaacgggaaaccaaatccacgtgatttttctgctgtttttctgccgtttcccccctcttttgggcctcaattgctccccatctctgtcccgtgtctgccccgccggaacagcgttatacaaagacgcatccgcatctgaacaacttaaacgagaactctagtctccgaatctcaatcacgatggattagataagatggaggtataaataaagggggtggcccgcccagaagcgtcttttctccgtcccagattcccagattccccagacccattctccctgccaacgtcgaccatgtgggccccaatcaaacacgccctgtacgcgcccaagcccgagcccggcagctcgcccacagttgtggaaaacccctccaccttccagaaaatcttcaacccgccggtcaagaaggacgagaacgccattgacgaaaacgccgcgcccaatggatcccaggaaatggccaaaatcaccagtctctggaaccgacacgacctgtggatggcgtggggctccatgctgctgatcgcggtggctctggctctccagggccgaaccttcaaggtctactccacctttgcaacctccgagtttgaggaactgtcgctgctgtcgtcgctggcagtgacccaggccgtcatcaacgtggccgccaccaccgtgtttgccaagctggccgacgtgctgggccgattcgagtccttcctgctctccgtggtcttcttcaccattggcttcatcatgttggcagtctcgcctaacattggcacctactttgctgcccacattttctacgtctccggctcccagggtatcaccttcctccagcaggtgtttgccgcagacacctcctctctgcgaaaccgactcttctttgtggtgctgcccaacgtgtgctacatcttcgtgccctggtgcgccgcccccatcaccaacgccatcatcaagcactccacctggagatggggctacggcatgtggtgtatcattgtgcccattgtctccatccccgtcctcaccattctgttccggctcaaaatgaaggccaagtcgctcaacatggccggcggaaagtcgctgcaggtgcgagacgccaaggagacactgcgacagtttgacttcatcggactcacccttctgaccgccggcctcgccctgctgttcctggccgtcactctcgtcaagacctccaagtcctggacagaaccccacgtgctggtcatggtcatcataggccccattctgctggttctgttccccatctgggaaaagttccccaagtaccccttcctgcccatgaagaacatgaagaaccgaaccctcatcaccggctgcgtgtttgccggcatccacgccatggccacctctctctacaacccctactacatgccctggctgctggtctgcaagggcctgtccgttaccgccgccaccaacgcctcggccaccctctcggtctcctacattgtcaccaccatcatcgcggccttcatcatcagatacacccgaagagtcaagccctgcattgtggccggctcctgtatctacaccctcggtctgggtctcacctaccactaccgacagcccgacgtgcctctggccaagttcattgtcacccaggccgtcgagggagttggtaacggtcttcttcagtcccccgctctggtcctgacccagtcctccatgcctaagcatctcgtcatctcagccactgccatctactacaccatcaactccattggtcgagttgtgggcgacgccatctctggctccctgtaccgacagcagtaccccaagagactggccgagtttgcgcccttcatggacgagaaaaccgtgcagcgaatggtcaacgacgtcaattcccctctcaagtttgcctggggctccgaggagcgagtcgccgtaatcgaggccttcaaccacgtctaccgtaagatgctgtacggccctatgatcattgccgccgttggcattctcattgccctgaccttccccaacatcaacatgagcgaggtggacaacggattcgtggtcgaagagaccgaggaagacatgcccgccaccgctgttgtcaacgaaaagaagcagcagcagccctcggagacctccgagtccgagaccgagaagaaactgcccgaggtttcttcctctcataccgtctcttcgggaccacgatccgcagacctttctgtggaggagcatgagcgacgagtgtaagtccaagctcctttttaatgacttttacgacaatgtatctgtgtatatattctttatacttgtacgataaaaaaattcaatgattcttctgcataataaattcattgatattatttgttaaaagagggttaaatccctttaattagtaacatttacttagaaagatagttatcgatttcagaactttgtaaacttgcaacaaaatccaacaatcaaaggagcaggacttgtatattcataataggccgcagactctcaagcactattgttttatggagctgtttttcgcggtcacgtgacatattcttcccgtcaaacaggtccactcaccttttgcaccagttgcggccatatcctggtgaaagtacggcttcccgtccgatcagccatagtcaagcaccagagagcccagttagtattgtagtgggagaccatacgagaatcctgggtgctgcaattcttttttgatcaccattgtcattctcacaaggccgagcctctctgctgtccaaaccctgagcccgcagtatgtgaatgagagcgacgaagtctagactgtcaaggaggtgaagtgtcactgatcctaaacctgtagatacggcctaggaaactgccgaggaggttgcaaaggaggttgcaaaggaggtggctcctaccaaggaggtattagaaaaactgccgggacgcgcccaatgccaatgttaccaagggccgaagaagagacattcccttggagctatggtgatagacgatagtggaaggaatggtgatagacaggcacatgcatttatataagttgttatatctggttacatagttcctgggttaaatagtgaacaggtccgagtctccctggtagcccatgatggtgttggctagataagactttgtaaaggtgtagattcccacctcttcataagatacccctatcaaggtgatgagtgtgtttgcgtgcatgtcacccacatccatgtaaaacttgttcttgaggtctatcaggcgttgacataatccttcttggttgtacaaggctgcgtactggccgaattcctcatcttggacgaccttgactgacgtgccaaaccccacatttgcaccccatacagtggaatctgttgcccaaatgttaccgtcccagcacagtagcactccgtctcttctccagacctggtccattggcggagttatcttcgtgaacacgccgtgccacacagtgtagaacttggttccgtagctttcacgcttgacaatgagcacaaaattgtaaaagaggtagatggtgcagcttgagtagaggaacgagacagtcttgtcgagtttgacgtccggagctcgtcctggggtgtctctgaacttgacgtacaaacctgtgtggatattgtgttcaaacagaacgacaagtgcgtgtggcgatgatctgatgacacaggggcgtttcggaccgatttccatttcgattccgtgagcattggacagaatcccgtcctcgtaccagatgtgaggctcgtagaacgactcctggtcttcagagaggttcacaaagcccgagttgctgaagaagccgttatcacagaatacaagaggagcttcctcctgcatcgttcctgtttgtttgcacagactgtagaaatctgtgggcagcggagtgtcgacgtacacgggccaagtgtgtttggaaaagtgtctcggaggcagctttcctcgtcttcctttcacataggccacggcacaggctctccagctggcccgtggagagtacgtgtagtacatccacggattggggcactcttttgtgagaagctgttcccagtcctggtccgagatggcgtagaaccacgcacgacaagtttgagacaagctcactagcgattgcacatccagaccaagacgggaaagcagctcccacggcaacatgttgattacatggcagaaagggggagtatcgtcgagattggcggtcgccactgatagactagacccgactttatctgaaaccagagtgaaagctatcttgtaccagtagctgaactcagagtgtaactctgaattgaagctgtgtagaaaggatgcgtgtctcaagacgggtttttaatggttgatggagatggagagatgtctgagtggttaagttgtgaagatttatgaattgatatggatttttttgggtattttacagttaaagtgacaaataatcactgtaaaataccgagctatagatggacgaatatccaccccatattattccattgaagagtgcttgaagtcgaagtggcatcactgttatcctggctggtgcactcgcgcggcggtttcagctcgtccacattggacataaatagcgtgctctaagctctctagagatcaagaaaaagcccgcatgtaatcaattggaattggtgaagataacatggggtttcgtagaactgacgattaactagcgctgtggtgtcaaaatgttttcacacatctctcaaacaattacccttcaatatctcgtatacaagccaccgaacttacgtaaagccacagaggaggctatatcagtgaagacgtccagctttgagactcagccaagaaaacctgtcagtgtgcccaccatcgagaatttgacgtcgccatcctcaagggctaggacgagaatggaaaactgccaaccaagcgaatcaagagcaccaagaagaacattctcgatgcctttgtcatgttcactgtacaccacccatgtcctgaagtagacgtggcgaaatagcgtgaaacttgttgcctttcttgttcacccacgctcatctcttcaaacttgtgcgagagtcattgtgtcccttcaagagtgagttgaatttggaagtatctcctcttgggcaagtgtcaatagttgtaaggacttggatggaatgacgagcaaaaggtgctcttctatcagatgaaggtcgaaagaacagcacgtttaaccggaggaatagcctttatgagacgaaaagccggcgctggaccaggagctgtcatatccgtagccgagattcgcctgacgacagagggcgttccagctgttactgtcaatgtccttgtaacgtgaaacgatgccatttggaagcaggtggaagaggctactacagatctccgaagcaatgagccgcgagttcttgataccatccgagatgttgtagatgtaaaggaccacatgaaagttgcatctgccagcaacagtagtccatttcatcttgagagacttgtcacgttcttcaggagaaatcttgatgacgagctggtcaggtcgagcgttgtacgaagactgaaccagtagccatagggctgggcacagcttgtcttgtttgtgtgtcatagtgtctcgacagtgtcatagtgtaagtgttgtcatctccatcatacagatgcctagcaattgctgatccctagggttaagatgaagtcgaagccgcacaagcatgaactcagctggccagttgaaatcatcaatttgacaaataattcactgatccagatctcgctgcttctattcaaggatgagattcttgaacaggcagcttgatcttcattgtagttagagcgactgtaggagccacccacacgatcaccagatgcgataatagtcatgctgtggtatatgtctgggttgatatagtctctcttagcagggttggtgagagtatcttcagagcgagcggaaggagggtcggcactgagagacggatttttctgccatttaagagcagcgacgcggttggcgatgactggtggctgtttatcgattttagcattcatgaggtcaaacttggtgtgtacttcgtcaaatccttttctaatgcggaacatcagtgttcgtagtgtctggcggtccttctagttctccagacgttggttttccagacgtctctccatatcttcttaagattggcgaaataataaggggatattcgtaaggggagattcgtagctgtgccaatgtcagtactgtaccatcattgtcaaggatgaggttttccagcttcctcatccaccagatacggtaaaagaagcggtgaacgggggtacagtacataatgcacaggtgatctgggggttggagagggggacctggcgttggcagagacgtcgagagattgggcatctcgtgtgaataatgtcacgtcggtaactcacttgtagtgagaaacttgtaggttttctttcgtaatttctttcttccaaataaagaggtaatcaatcgcatttttcttgtctgtgaaggtagtcttagtaagcaagaatttcaggtgattggatggtcatgtgactccaaaaaatcacctgaggataccattcttcaagtgaggggaaccctagattaaggttactcaataaaatgtcgttaatatgttgagtaatgtttgggatttagacaagaacgttaaaatacccaattaattctccacaaacgatatgaaactcaaactggggagcatgctccatagggtgaaacaaaaatgcatagagttagttgagggctagtggatatatgtcgttttatgcacaattttcaagaaacctgttgagtatatttaagctataaagaaattgttgagtaacctaaaataaagtggcataaacttgcagtacggtaccataaacttgccatattatcaggccactttaagagacaatcagaccactttcacgaagcttatttctttgggcataaactaacgtcgagatgtatttctggtgttagcgttgataatgcagggaccaatgagacgaaaaccttagtatgcactacttcgaacccaaaaaatggacatcgtcaaagccggagttgaatggagtcggattcgcggttttatataatccatcttgatacgaaccccgcacgagaaaatcagaccataatttaaggtcgcatatcacctatagcttaattgtctgtttgtgtaatataaatatacccccaatttccagattctcccgaatcctctattcatgttaaccatcatcgccaagaatccgccaagtacgtgtttcgtctcaaacactgaaaaagacgggttctttttatcgccggctaagaaagaggcggcttgagtgagtatttatgctttcttccgttcgactggcactactgcggactttttgcaaccgttgtgacgcaaatcgggtgtttgtgacacaaacagttcaacacacatcattgagctacctcaaacaacaccgtggattatctcggttcgttactacaaccgatgacgtttcaactacagtggccatctgcctcactgccaacttttttcgaggactgatactcacaaccaagccttgtgacacaaacccggcaccgactgagacaaaaacaacacaaacacgacacaggcatacaacttactacgggttgtcttgtgtttcccgcaccttgatcatttttcaaccgagtttcggctgcaagaagtgttcctccccagttgccagtgccacgtcttctcctccacaatcttcaacatactaactcagatgggcgtcctaggatctagttactaccataggtagggctagtcatagacgggtgcttcccgaagagctatgagccatacgactgtgtcttccgagggtgtcggataggcacggtcaggccagagtctccaggggggcatctcaatcccaaggaggaatttattttgtttacagggagggtgtgcgtcaaccatgcccaggttccaagcatgctatggactcagggacagagtctcatagggagtgccccggaaaacccgtgtctactggcgattttcgtctttagacacgacgctacaacccagtcagtttcaaaccaacttgcaatcacccttcgcgtcccaagaggggattctgattgcacagagacgaaaccagactagcgtcactcacgttctcggcggaaccggttcgtgagatttacttttttacttgctatcgatgataattttggcactggtgacgttggagcataggagatgatgctcttggtggaggaagggaggagtggattcgggggcttgtttgcaagacaggaggcggggggaatagtgaggggcggtgggtgttggatggtagatgagggatggtggaaggggtggtggatggcaaatgaggggtggtgggaggccgtaggctgtggattatggatggttgggcgtgtgagggagaaagcacttgagccctctggatgtatgtccgggatccctcgttctcaatcacctctgtgtccaagggagaaaaaggtcagactttcgggttgtggtcttctcaatcccatcctccccggacagtggaaggagtgtcgggagagggatgcgacattctatggagttgggattgtgtgggtgggatatataatttaatgtattgattttcttgaagcgtatgagctgtatgttaacaacttcgacataacccgaagcattaccttgtattgtataaatgcgactgtatcttgctttcaagtatcagaacggagaaagaggttcgtaatggtcttcgacatgggacaaatcaattacgatccattctcacggtcatctacgatccacctttaagacgtattgaactcttcgaatcccttatttgtctgagttatatttgtgggatcgaattcggtgagatcgtttatggagcaacgtccagagcgggcagtggcatcggataatgagtactctcagatcctcacgccaaccgacacctttgtctcctgtctgatacttggaaacaggaagtaattacttccagacctctacaccaccgacagtcataacacgacaactcgtacatctgggcttggtgccagttcacacatcgatcagtgcgaggaagtgagctccgatggagggtcaatatcttggatctgctgcagcagaattaatctcttgatggcgttgaacttcgatctcgttatggaccatctcagacgaccttgttggcggcgggggtcagtttttagtcattacgaggtggatttcaatgtgcaactacctaagtaagttgattattaagcgttaaatggagctgagctatccgtcctgtacttgcatcacattgtttacaagtgtgtactgttcttgtactggcagtacgaagttccgtcgctactgtggtcaattgctccattatggatctgaagcgatagatctgtgactgcgcgtactgtacaatacttttacttgtcaccaaaggagaaatcaaccaagcaaaaccattagatccgctattgtgcccggtgaaaagttgtcccatattctgattgaacaaagagatttagagttatatagccactcgatacgacgaaccttatccacaagcgagcccaccttcgatagctcggaagaatcatggattaaaagacattgaaaaaatgctgatttatgtaaaccactttgattatctaatatatactccccaaattattatgtaatcatcccaatttccaaccccatgatgatgagacgtttctcgattcttcgacagagctctctctctttcatttatgcaatgatcgccactaattttgccactaatgcagctctgaaatcacaaagtgaaatccaattcggcctagtcaacaatataaatggccccgcaatcgccctgtttttcctgtatcacaagtccgtcagtctcacagctttcgcagaggattcggtcactttgagagatgctgacattgccgaccgaaagcaaggaagcagtacttgtcttgcttgagcggacattcactttactcctctcaggacgcaacttgagttctcttatgttgccgagttggagagtcagcacacctctcttcatgcatctaaggatggagctgtgaggggcaaaggttcacaatctactcgggagctccttctctcagatggttcgcaaccacaggtgaaattcctagcatgagcaacactttggggtcagctctactggtcctgtctcaagacagtattccagaagttgctgagcggaagctgtaaagcctcagcgacgccgcaactgttgagactgattaaaaccgtgcgtgaagaacgcatgagcgagtagctaagacgtgaagttcagcacaagctacgaagctgccgagtgaaaagaaacccctcagtacatgcgctaagaggacgcagggtgatgacgagttggaggcttagcaagcccctcatgaatcctgtctccatggatatggagcaatgacgggcaggaaacattgtccaggagctctcctacagtatgggtagctcccttgggtgcaactccctgcatggataacaactcctgaatgctttggagggatggactgtcgtttgaacagtcatatgtcccctccatctgctgttgacttagtatcagcacaccagcaatcacggttaagagaacagcgggcacacgaaccaaacctgatccagcttgtttcgcattactgtctacgaagaccgccattgagcaaagcgtttgtgcccaaccggccaaaccgccagagcaaagaaccagtccgagccgcaacgagcctgagagccaccggccgacaacacaacactgaaacaacgctgaaaagccgcctggagctgcacgaaggtgaaactccaccagccaccagagcaggagatgttgcagcgcctgaaacacgtcaagtatgacgacagcgcaaaggagaaactgtgaactgcaagagcagaatttcagcaccatctgaggacatggtccggagccatcacgataagagccagagccagagccagagccagagccagagccaaagagcaacaagaagatgtgatgagagccactccgccataagttgatccaaaagccagtaagtgcttcaaagcaagtgagagccactcgagaagtcggagatccaaccaccagattcgcattcagaaaggatgtaggcgtggaacctccctatgaggatgtacaccagccgagcctttagattacagaacaagaggatgtaagcactgagctgaacctctgaggataatacattatggaccatagagtcccacccacatcgtcacctgtcgttagacttgcacgagtagtttttgtttgcacgagtagttctgttgaatggtagatgaagtcacagtatggagtgcatgtgctgttgtagcaatgtagttacatgtagtgtatgtatgtactatctagttctcttttatatataatatataattgtacaacaaaaccaacagttgtctcagttgtatccaacatgacattgttggcgttagtgatcttctagctcagtatatcaagtacgtctagggacacgggtgttggataagtggtctgtaccagagctgtgccgtagtgtgtactcgtactgtacagtcgaagacagtatatttattttattgataatctgctggagtcgccgaatccatggtctagccaatggatcagcttcgcggttgccctcgcacctactatgagccaccttcaggatgcaaacatctcgacagcatttcttcttctcagcgtcaaaatggactggatcaggtcttggtttgcaacatgtagacccctgctgttggtccatccattcctttgccagttcaggtactgtacacaccccttttgacgaagttgagaccgtaggccgagtcggtgtaaatgttgtagcctccgtcgtttagactgtagattttgagattttcctcgctgatggctgccagctcgacgctcttgttggtctgtatggttccctttagagattttgacacattccagagttgtttgctccaacatatgcgccaattgcagccatggatcctggcttgccattgccatacgtcccatcagtatacacttggtatacgcattgccctagaccaggtgaaggacagatcttcgcggagtttctctgtgtaaagtagttgagatgccggttccaaacgtgtcgtctcgctgccttattgatcgaaactcatgccagtcacttccacatatatttcccctgctatatcgaagcattatccgtcggactataacgaagcacttcccagttttagtaaacagctaaccaagtagttaatgatttgtttagttatggaccctcagttgaaagaagttatatacaggtgtactgaatgtattatgcagtaaaactggtgtttgtttctgtttacttcctggtgcgcactgctaatgatggttaaccccgtttttggtttgtacagtaggaaataatggcccattacgtcgtggatcaattgaactcgagacccaagtatgtacccataccaactgtaagcatgtacgagttcagttatgtattccagactcgagatttctgggcttccatttacttgtatgtatgtacaacagctcattttcaattacacatcagttatccagcagcatattctctgtcctggtcttccgcgattgttgctgtcatcatggttcgcgagtgacgacacaaccgaattcgctttggacctccaaccacatggccagtgaactgcctgcgaggaatcaaaccgttcttccactcgcggtaagccttgccacctcctttatccctgaaacatcgctcactcgtaacatgtctttggttcacacagacctgacactcggggccagccttcctcttcttggaggcttgtaatgaccccacgcgtttccgtctcggaccaacaacttcgccctcaatcatgtgtgccacaagatccccattacgcggaacatgagcatggacctcttttgcgagctcctcgtctctctttttccacgctttctccgatcttcgaagcgcttcccaccgttctctgaacttgccataattacaagcctcgtcccattcactttcactcatctgtgtggttgtgtgcaagtatctccagcggggatcaaagtctcccagcatgagcatagctcgacgtgtgtgtatctcggccgtaccaaggtctttgtctcccagttcagctctaggtcgcatcctttccctgccgtcctcggacaagatcaaatcaccaatcatgtgataacatgggagtccactaccccgagaatagttccctgtacacgcactgggaacgtagtcgtcgtgagaagcaacagatatctgctcgatgcacctcaataatgccttggtggaaataaaactccggacagatttgcagaacctcttgttgatatctttgcgatacctctccatctcccgtgcatgggcatgttctaggtcgcatagcacgttgaccgaggtacgcagaacagccgttgcactttggaagagagaaataattcttgtcttcatattactcttctgaagagaatgaatactctctatcctggaggaggtcgtcgtctcgaaaaagtcgctttctctagtataggcagccacaatgctgtggcgaagttctggatgttggtcgtttccaaaccaatgtctttgaaggtagtagtatgccgagtttctctttccattgattgaacgatcgttcctgtcggcgcggtccatgccctcctgcttataggttagttcgaagtcggtgtatagcttttcaaactcgtccacagtgtcagcataacacatctttttgaacctcgaaacaagtagagatgtctcaagagatttcaaaccaaacaaagcagtacctcttttctcgactgctttggcagcatgccacaaagagagcttcaggttactaccattgagtttgctttacttgtggccatttttgatggccggtgcacaatctgataagatcacaccggggtcgggaattaggtacttttgtaggaagactcaggcgatcgaagcaccacttgaaagtatctgcatcctcttgcgaaataagggcatgggcaatatagaacgacctgccacaggaggcaatgccaataacattgacgagcttgtagttgaatttgtttgtctcgtgagtaacgtcgatagcgataacaccagaaaaggccctgagcatcttcactgacttcaagagaacgaaaaacatatccttgatcacgtccggttgttctggcaggtcagtgtctggcgacggcgtgcttggcggggctcgtcgagtagatagtctcggtctctttcgtggaagcggttcggcaatcgcctcatcttctgattcgtccgccacgacttcgatctcatcattttcgtagtccaattcttcagtttctgatatcagctcagcttccaccaggaggtcatctccctgattttcacctggttcaggcccttccgcgtcagacccatcatacatatcaggttcccatctttcctcccgtcgatcttcctcaagctgctgctcttccgtgatctctgggggacaaccgacgaccctatgttcaacatggaactgaggtgagagttccaacatgatcaagagcgcttcgacggggtccaagtcgagtgagtctggaggcagcaggagaaaggagacgtagagcatccagaatcttgcgaggaaatgtctggatcttgaccagaatgtcaaaaagatcaatgtcccggcatcccttcctgatattggccaaatcaagctgtcggtgggcaccattggttgaaactgatgcagagggcttgtgattatgtttcccacacagggcgtctccattctcatcctttttctgctcatggcagtaaaccagtccaaattcattcggaccgtgcttgtttactcttatctggaaagggcaagaacatgccacctgtctcgaccctttggttggctgcccaatctcttcactctcatggtcatgcttgtacttatgacactggagaatgtttctgcctttgccaccacccaattgcaagacgaagccaggagtcgtgcagttgtctgagcataggcgatggcttcggccttttccttgaatcttggcacactgagatcggtgtggagcattttataatcaaattcagcttgaactttctcaaagtgatagtcgaaatcgcgcccagtgtctgcgagttttttcatgatgtccattctctgttcagcgtttctgtcctcaaatttgagaggttgcgtatcgacaactggaggaagagccaactgcaaaggagtttcgacaacagaatcaggtggggtatatgggattaattccacagttctttcaacacgattttctacctccggtgagttcacatcaatcggttcaggaggagtctcaggaacacgttgcaatggttgcaatggttgctgtgggagctgttgccgttgctgctgtcgttgctgctgtcgttgctgctgtcgttgctgctgtcgtttttgccgtcgttgctgctgtggctgtggattctgctgtgacctcctcgggacatgttccggaaaatccgcactgcacgcagacggtgccgggacccgcggaaacatgaaagggttctccacggaaaagttcaagtaaggatctttgtcgtcgatattgtcaaccccgatttgcacgtgtttcagctcgtcggtagtactcaactgttcgtatgtgccgtctgctgtgcggagatagacaaacacttcatagtcgagtcggaaatatataggctggggtgctgccggctggttcaacagaggtcttgggttcttgtactgcggtaacggcatcgcagggggatggtacgcgaattggggttccattggtggttggagggagtcattttgctgaatcgggtggtcaggcatcatgttcattggtgccatgggtcccatatccgctggatcgacgccaggcatgggcggtccgttcatctggtcaacagacgtgttgttggtatgttgaaatggctggtggggcaccggcgattctggctgccctgacatgttggacttttcgtggttttgtactgctgaaggagtcgtattctggaggtgtggtgtacagggatggagatgcatgccagatgcatgcatagacgcgcatgaaaaatcaatttaagcgagacgcgtagataccgttatcgtacgtttgttgtactgtattgagtgctttattgtaatctctgtgcgaaaatacgcgtattggacggtattataacggactacatctgtggataatcgctacggctgccctcgacgtcacggcttgcgtgtccgattgtggagggggtactttgagttatatatatacagttctgtcaagggcaagtgcagatacacgtccgatacgagagtttcgttgcatcagacaagacgcaaacacaagacggcatcgcacttgtactacgacacgggtgcagaaatccatcgccaagtcgccgtcaccgtcacaatcgatcaaaaatctgcagcaaaaggcgtcggagctgcaaggaacgccgtgtaaacggacgagctgcttgagaaagtcaatggtgacgttcgtcagagcatcaactcggcctgggacgcctgcaagcccggtattccttacgagccaccctggaacagtgtcgagaggccatccgaaagcttcaggaggctgttgatggagtcgtaacccagttcgaacctgcaatcgaacaacttggtgagcaggtacgagaattttgatatccaagaggtgatttctcttgcgctacaggagcatattgtccaagtgctcatgggccagtcacagcagattcaacagcagattctgcaggacacagttgctcacagatcgttggactttgctcgtaacacgcgaccttctcgccccaaactgagcaaaaagcagccctttactaaagacgcagatattccgctcgaagttgcgggtattatcttcgagcactgtgatctggaatcaattgtgcagttacaacaagtcagttcatactggtactcggcttaccggtcgttggacaatgtgctcaagacgaaggtccagagccggaacccctggatggagcttggagagaatggcacggaactggacacctggggagattgtgctttggtgtttgtgggtcggttgaatagccgtcagtggcaggccgtgaagactgtggatgatatcgatctgtcctcggttggtaaagcagcttccaatgtcattctttacagataccgaaagggagctgggcagcctattcaattgtctccgggaacctactttggtgaatctgcttgatacctacgacctggaaatgcgcactcttctagccaccaagagggacgaggtcactttatccaagcaaacgtacgctgtttgtgaagaccagatggtggtagccttttttgcggacccacgcatcccccaaatcaagctccctccccctagcttctttggtttgcccgccagtgtagccaagagctccctttctgtgtctgttggtgatcagcacattgttgccaccttttcggggcctgaagagatggtctacgtcatgccccgtgacttccctaactattactacggtcacggattcacttacacggccgacatgggtcgtgatgtgacgaattactttctttcctctgcgcacgccttgcgtctgagtaatgaggaacctgataccaagggcgccttccttctttcagacatgcctggcaaacgttttgtgacattgtacgaggctgacgcgcgatctacgcctgtcgtcgtttacaacgggctgctttgggttgctgttcaccgtccatctcagtcgatatctctcgttcccattctcattgacctgaagggctcttctgaggaggctgatggtacagtttccctgtccaaggtgtactggcgcaagtcccgtgcgattgtggggctcaagggccgtcgtcaggtacctggaacctcgagattgaacaactctcatagatatgtgactctgtgtcgagactccaaccaggtggacattgttgatttagctaccggtactgttacacttgtagctggcgccggagaggtcttcccaggcttcactgatgggagattcgaggcgtggagttacagcaacaaggcgtttgatcggttccgaaagttcttcaagcggttcagaagactgaaccctcatcgactagggtacgattttagtcagatctcgacccaagacgaggaggaatggggatacaaccgatccggccagtgggttgctcttactgaggaggagctggactatgaagaagagcatgaagaacaggacgaggaggttgtggaggaacgacatgaagaagacgacgaagaagaagaagaagaggaggaggggggggaggaagtcgtttgaggtaccgatagatggggccggtggggaattatcagtcaggaggagctgcgatacaatgaagaagaagaagaagatgatgatgatgatgatgatgatgggtggtagtaaatggtatggtatttatttgcaatgatgctaacttatgttttgtacatgtaaaggcagcatcaaccataataatgtctttcggcagcatcacgagccagctcgtctgcgccattatttccttcgcagtcactatgggctagtactttttcaattccaagaacatttcgacaaccgacactattgaggagcttcaaaatgtctttgattgtgtcctggttagacacaggataacccttgcagttaacccatccgtttcgctcccacttatcgcaccattctgtgacgcatttcaaggcataatccgagtctgtgtaaatctcgtagtactcgccattgacccactcttgaatgagctgtagggctcgcttgatagccacaagttcagctctctggttggtttggagagttccgcccagaatcttggactcgttgaagggattattggctccgaaatagacgccacacccggcccttgcatctcgtttgccgtttcgaatacatgccccgtctgtgtacacttcatagactgtatcgccttcagcgtcgacgaaaagaagatcttcactcagacgctcgttgcagttaccatattcgcagatcgcctctccgcgagcatcttccaagttgaagaacactttacaggattctccccctgagtactggtgggctatgtcgatctcatcgaaaaccagatcctcccacacataatatttcgtcacgttcgggttctcatacatgtactccagggcgtcggcgtagcggtgggaatcccttccactcggcgcaagagtatcctctgatctcgtccttcgcatcctccacgtcctcgtagatgcctgtggtgtagcccactctcacggcgtaaaagttcttcattgtgggcgtggctagagtcaagtgtgagcaatgtcggtattgttggaacctttggatccgcagtttgatcctcggctgtttccactcgacgacgcaatcgcgggttacagtcggtgacgtgttttggcggcacacgacctcgttgagctgagtgagttcgattcttcagagatgaatttgggaagtagtggggaaatgaagtgatgcagtgattccgtagggcagcagtagaagtgacaagtaccatctatctcaaaggtattagatattacgaccaagcaaaatatatatctatatatattggatgtttgttgatgagacagtggaaacagattatgactacttgtacagtacagtatgtactgtaggtacagtatgcaccaatgtttcatctcgatgatccatctcagtgtttctcgatgattcgcacaacagacgcaaaaaagacccaagcaaagacgacaactagtgatcgaaacgactcctaatatcgctcctttgtccccacatgcatctcgcttatcgctatcagtcatcttatcaaccccacatcggtatccgcctcccgcatgcggctagagccaaaaaagcaggtacagtacagcacacggatcagcgtcttccacgtcatcaatactgcccatcatcatgcctctgtcgcggaaattcgagctcgatgcagagcagattgcgctctccaagaaactcaacaatgtgctgcacggcgacgagtacgacaagatgatctcaaccatgggataccaggactcgggacccgaactgatccagggacgccacaggatccgaatggcccaaaagaagtacaacgactacttcccggagggcgctacgcccgatgagctggctgaggcgcgaacagccatgctggaaaagatgctgggtcgagtcggaaagggagcctacatcgagcccccggtgtttttcgactacggatacaacatgtctgtgggcgagcggttctactccaactacaactgcacgtttctggactgcgctctcatcaccattggcgaccgtgtgctgctgggacccaacgtcaatctcatcaccgccacccacgacgtggacgtgcagtcaagacgagatcatgtggagtacgcggcgcctattaccgttggagacgactgttggctcggatcgggggtccaggtcatgcccggcgtcaacattggcaagggatgcaccattggagccaactcggtggtcaccaaggacattcctccgtactccgtggcggtcggagctccggcccgagtgatcaagaccctggaggatcctgacgcggaaaagtgagcggtcagaagtgtcgatcattgaaaccagcggggtagctacgataagtggctaacgtgaggcgcctgaaaagttgtttgtggtgtgtgtaggcttgtaaaggtctgcatgctaaggccccactgctaaaaacactctgggatgtatcgatctgtggtggttgtggatgtacctgtgagtagtatcgtcggttttcacggattgctatcattatttgtatgggttttgcaatcaattgcgttatttctccaagtattatagatggtatgatatgatattacagtatgtatgtactggacagtatgtacatacatacatacatacatccaagtacaatacaatacatgtatagtagcagagtgagaattggacattaaaagggcttgtattgtattcacagaatttggagagttaatcgcttttttcgtcaatttcgtcatttcgtcaatttcgtcatttcgccaatttccttactcatctgttgtgctatcaaaatggaacgagtatataaaactgctttgaaagtttcaatgtctcaactgggggtttcacctatcacttgcgagggttcaagcagcttttggccgccggtacagtaaaagtattgaaaaatgatgctctgattttccaagtccacactatgctacaagtactacaagtagttgtactcgacacgagagattatgagtgcttgtacttttactcgtatatattgtatatactgtactgtatatattgtatgtactgtatcttgtactgtatatacttgtctacttgtacttgtacttcaccaaaaatctacgaccataaacacaaccttcatatattctggacaggtgcagaaatcggcccaacccgcctaatatctgattatgttatatatcaaagatgtggcatgaatggtagaacccgtgaatgtgctggagagcaaccgataagagcgaaaaagtccaaccaccagcgtcgacaggacagactgaaagttcttcccccccccccccccctttttttttgtcttttccctttttccaacgtcttcatctgacgtaattactaaatgttctgtctttctcttacttcgctgataggcacggctactgactattgcgcatactaaacccagcaactcaaaagtgtggggtagcgccctagagcaccatctatgaccccaaacatggctgcccccgccgctttcaagagcaaaaaacggccctttgcgcacgccactgtcagctccccggaaaaacatcttgatgcctgcatatccacctcaacatagtcacacaattgcatgcgtccagggagcatcgcggaggacgagcggagacagacaaggggggtacaactggacacaaagagcgactggacgcgccgcaacaacaacagcacaaaggccaagagtgcaaaaagccgactaggcaggcttggacctatttcatgaggttgtccgactcggctggaccacttagggcaagacgggccggttgtgcagcaaattagactgtgtcttgaaggggcttatcagtgggcaaaacgcggatattttgggcatttttttgcccagataagcaatttgaggcacgagagggatcacaaccgccacatatggccgaaaaaacacattattttcccggtctgagcgcccccgaaaacctcccgaaaatgtcttaaaaccgtcatccctggaggttgggccaacgctatttactatcgtgcataaaatgtggggtagatggtgcaggtctctaaatcactggactccttgttatatactatctatctatctatatataaagagacggaggacgccatgggagactaatcacgcattgctaaacaccaacacatacagtcgtcatggccaccacagaactgccagccacccaacacattatccacaaggcgcccaaagacgtggcccagctcttctacggaaatgtctccgactttatgagaatggctccctcccagggcgacaagaagatgttcatttcggcggagaccggcgagtcgcttacaaccgcccagcagtgggccaccgtggagctgtttgcctccaagctctaccagctgggaattggccactctctgcgccccaacagcgacgcccacttgggagacgtggtgttgctctacgtcaagaacagcatctacatccctgcagcccactgggcgcttctggatctgggcgccaccgtggcccccgcagccgctgtctacaaggcccgggatcttgtgcaccagatcgagctggtcaagcccaagctgattgtttgtgacgcagacctcaagagcgaggctgtggaggcgctcaagattctgtccaagaagatgcccatcgtcacaatggaggagctgcgacagcccgtcaagaagctcaagcagcgccagcggttccgactgtcgcgacccgaggccgccaagcgagtggcagccctggtcatgtcgtcgggcacctctggcggtctgcccaaggccgtgcgtgtcacccatcatgtggtcacctccaacgcgcagtgctcggcaattgtggctcccgatctcttcgacgaccccaccaacgtcatctccgccgtgctccccatgtcccacatttacggctacttcaagtttttgtttgcgtgcttctacaccggcgagacctgtgtcgtgcaccagtcgtttgatctcaaggctgttctcgacgcccagcaaaagtacggcatcacctccttcttcatggtgccccccatcatcattgcgctcgccaagtcgcccattgtggacgaatacatcccgtcgctgcaaaagctgcgtttcatcacatccggagcggctcctctcggtggaaacgtcatcgaggacgtcaagcgacggctgggatcccatatcgccgtcacccagatgtacggcatgaccgagagcattctgtccacctgcttcaacccctcggacgccgacgtggcctcccggtctgtgggcaagctgtgcggtaacattgaggcccgtatcgttggacatgacggcgtggaccagcctgcatacaacgagaccgaccccgacaagattgacgctgctttcaagcggggcgatgctctgcccagcggcgagctgtggctgcgaggtcccgccatcatggctggttaccacggcaattgtcttgccaacgaggagtcgtttgtggacgcctcggacgcggccacggtgccccattaccaccgcaagtggctgcgaacgggcgatgtggccgttatcgacgtcaagggccgaattgtgattgttgaccggaccaaggagatgatcaagtccatgggcagggccgtggcgcccgcggagattgaagctctgctactttcccaccctcaggtgatggattgcgccgttattggcgtgcatgtgcctgaaaagggcaccgaggccgcacgtgcattcctggtgctacgggacgcgcaggccagtgtggcccgcgacgtggccgcgtggctcaacgaccaggtgccttcctacaagcgtctacatgggggtgtggttgttttccggggtgaggtaattcccaaaaatgcctctggaaagattctccgtcggctcttacgtcagcgaaagggagatgaggtggtgttccctgagcgagctaagctgtaagagggtgccggtttgtcagggtctgtttgcagctgctggtacagtgactcggtagctcgcgcccgtttttccgtgaactttgtgcaacgtgctcgatagtttttgcctgtagaagtttcatctagaaaaaaaaaaaagattccacttttcacttttccgtgttaaaatctctctaaacgtgcgcctggagcctatgagctacagtagggagtaagtatcacctcccactcttttgggtttgcagttaggcacttctaaatccgaatatatcctctcatgaatctcacactatcgatagtctaaaagcctaaagagggaggaggaggggggcgaggggggcttcgaatggatttgactcctgggtagagtgtgcgcacaagcaaggtgtgggaggccggattttggcttgtgcaccccacgtggggcgctaaatggggccaaggtgtaaaatttgcccaaaaagcgagcgtggagtcgagcagcctgggagtccacgtgcgtgaggtggtgatatgaaagaagggagtggtgccaatgcgtcattttttcttggcgccgttgggacttcacgtgacccaaaggggaggcccaaaaagcgcccccggggccggagaggagtgcctcaagccccccacccacatggtcccgatggatcgactggtgaaatttttttcccaaggtaatttcaatagtgtaaggtacttttcaatttgcctcttttcgcagaagaaggacccaaattcaacctcttgtacgacgatagtagacttggtttgggttgactttgcttttatccacttttcgtttggagctcaactctcggcggtggttagcttcacagtagtttgcaactccaaagactaacgctgacaaggccactggcaaactcagcgcggtggacgaggatggaggtgtatataacctgggggggtcccggaccgagttgagcagtcaagcacaaccactccaactcttcaatggccgataacaacgtgaccgaaggtggaaacgccgccttccacaactatgtcaacgactttgctcacattgaggaccccaacgagcgacgacgactcgccctggagaagattgacaacgccagcttcggctgggagcacattcgagccatcaccgtcgccggtgttggtttcatgactgatgcctacgatatcttcgccattaacctgggtatcaccatgatgggatacgtctactggggtcagaccatcaacggtcccggtaagccccccacctccactgccactctgctcaaggtgtccacctcagttggtaccgtcattggacagtttggtttcggtattcttgccgatatcgttggccgaaagcgaatctacggctccgagctcatgctcatgattggagccaccatctcccagtgtatggccggccattccgaggctatcaactttgttgccgttcttaccttctggcgaattgtcatgggtatcggtatcggaggtgactaccctctgtcttccattatcacttccgagttcgccaccacccgatggcgaggtgccatgatggctgctgtcttcgccaaccagggctggggtcagctcatgggtgccatcgtctccattgtttgcatggctggtttcaagaaccagctcgagccctctcacagcgccaaggactgtggcaaggtctgtcgacaggccctggacatgtcctggcgaattctggtcggatggggttgtgtccctgccatggccgctctctacttccgactgaccattcccgagaccccccgatacacctttgatgtgtctcgagacattgaaaaggcccagaaggacattgaaaagtacaccaacggtgacaccagcggcgataactccgacaagaacgatgagattgaggctctgcgagccaaggccgaggccctggccacccagcaggcttcttacgctccccccaaggcttccttcaaggatttctgccgacatttcggacagtggaagcacggaaagattctcattggtaccgccggctcgtggttcttcctggatattgccttctacggtcttggtctgaacaactcccagattcttaaggctatccatttcgataagggagacaacctgtactctactctgatgaagaactccatcggtaacctgattcttgtctgtgccggagccattcccggatactggatttctgtggtcaccatcgataccattggccgaaagcccattcagattggaggtttcctcattctggttgctctcttctgtattatcggtttcggatactacaagatccacgatggaggtctgcttgcatgctacattctgtgtcagctctttgaaaactttggccccaacaccaccaccttcattgttcccggagaggtgttccccacccgataccgatcttcggcccacggtatctctgccgctgctggtaagatcggagctattatcgcccaggtcgttattggtactctgattgaccacaactgtgctcgagacggtaagcccgccggatgttggcttaaccacgtcatggagattttcgccctcttcatgctctgtggattcttcgtctccttcctcattcccgagaccaagcgaaagaccctcgaacagctgtccgaggagctgcatggtgagatccagtggcgacccccccacgagatggagcactcttctcatgacttcaatgaggaggagaagtcggtctaatttcgaccctcttttcttcagctccgctcttttgcttctcaccgccaaattatcagtttttatttgagtttaatgtaaagtcttctaacctacatatgatgcaaccgtattcgcttaaaagtatttatcgcataacccaaaacggccacaacgtgcgtaatccattggctgtggttcttcggtctcggaaagccaaacgttttggtgcaactctctccttttttcatgtatctaattattgcgaaagccccatacggctcgtcaccaagactgaaagtgtgaaaattttcacttgtaggcgaccaagttttttagtcgagattcggggtcaaggagacggatcaagaaacacaccaagagacagaaaaaaacacttgtcctactccaacgcccaaccagtatacaccccgctgagacgcccaccacgcatgatagtatcagagtgaaacccagattcattgtatatgcatcgatatggcgttatcataaacctatcagtagcaatagtgtttctttgttagcccagatgtgcgaccgtattgagatgcggagagccaccatcactgttattattattattttcgcactaacggccaaacctgctggagatcccgctagtcgtgccgccggtcacacgaccaattggagagcaactgtgatctgctccacaggattcgttggagcccacctactgcaaacggcaatgctccgtggtaagacacttgccatcgacaatggcaaaggaccacgcatcgtaccgagtcagcgtttaaaccatagggctgtgccgcgcaaattggactaccttgagctaacagctcagcttgctttagagctacactagcgcattcgttttgcagagtcttttcggctggctcaaccttgtggtatgctgacatgtccaaacatgtgtgcttggcccccttcgtggcagcccaaaaagcgcgatatatagtctttggcggagagcagacaccatatgaccggggttcaacgcaattgcgtctttgagggattacaagtcgagacaacgtcgtctctgagctcgcttatagccgcactccgctagcattgctttacacccgataaacgttgggcacactttttgtaaaaaagactgatttcgattattccaatataccccaccgccatggtctggggcttgacggccgtattcgccagtctacagaggcggttttgcgcaccgagcgaggcacgcagacccctgtgggggcgccgttgtttacacgcaacaaagagccctgccaagagccatatctcgccggtacaatgcgtacccgccaaactaacttttgacaagctagcatcaagcctcgctttgctttttccacagggttggcgctagtccaaagaaggccaggatggtgtggtctgcaaacacgtgcctggatatcgtctcttggcacacgtcttggctacgtaatctcgccctttagccggtcttggccatcgccactaggtcacgtcagactcttggcgtactcggggcacacgacactcgtccacgctagatgagttggagctccgccggccccgctcagacatgatctcgcgaacaaaatgtcgatcgaggcatatacggtattccgggaaatatccactgtgctgctctggtgctaaactctgttatatgtccgtttggctcttggtggaatgtttatatggaggtagatttaggggtgcaccggccgcttaggaggtaggtagtgtaggtttggccgtctctctgaggtcggccgaacagtcggacaaatgagcctctgtcggttatctccattcgatcgtggtgaccatgataggttgcattgggctccaagtcgggctccgacgacccccatgctagcggcagcttgttgccagtatagtagtatctctcagcgagtttagggctgtcagagagtagcttgagtgggcttgcagggtccagattaggcgagttgacaactgttccagactcggtcatgattattgatacaggtttgataggcaatggggattttcttttgggctgtgttttttcgggtcggggaccccctccaggactgacggctcgactctatatgaacgacattgggggtcttgtattaccattgcctggggtttcgcattttcattaatcgaatttaatcgttcttttaattgcgaatcaatgttcctctcccaggagctctctttcacctctagttcgcccacgtgcgggataccggcctgtgattgggagctgggatggtggatgaggtgttttataataagtagattagctccaggcgccaactacagtttgataatagcgacggttccaaactaaaaccaaaccaaacctcgaacctcaactctctccctgtctgtccgtcgccatccccgacgttccaacttgtaggctggattgggttggatttgaaaaattttgtcatctagattcgatggtgtgacgagcaagggcgcaattagacggacaattgtggttattgcactagtgaatgttcaatcggcccacccacttgtccagaatccgacattgctcctagaacatgccgaagaacagtccaacaccagccaacaccagcccaagacctcatgccgatgagctgtatcctgtctggaatttgtccctgtgcatggacggtatcaacaagcacggacggtacgaaccaagcacggacggcatgaaccaagcacgggcggcatgaaccaacaacggacggcatgaaccaacaacggacggcatgaaccaacaacggactctagctacagaagacgcacagagcgactactgcacttgtaggtagctgccgatgccgtgctcgtacagtagctcaacgtgttcgtgatgtggctactgtatgtactggcactggactcgtacgatggggattggtacttgtgctagaaccgcatctgctcattccagtgacccgcagcagggcgtattctgcatttctctcgtctttcttccacgtgcttttgtcgctcttggtatgtctgcactttcacctcgcctgttttggacatgggtgagtgtttccgtcttgtcagtaggttagagttgctaagagtcgtgtgcagtgtcgtgtgccaaaagtcgtgtgccaaagtcgtgtgcctttttttatattttttttaccctttagagtctgaacggtgcatggtggatgtagacatggggggttgaggagggcggttgatgggcgttttcagacccggtaagaggcgattaggtgtctccaaacgcttttacaacggatatgtgtttgctcgatccgttttccccaagtttctgatttttcctgatttttcctgatttttcctgatttttccgttttttcccgttttttgtcgttttttttttattatcccaaaaataccccactctccattatttccgactgtgcagattcccatatcaacccaatctccatcaaaacaccgcagccaaactctggcaaaagtgcaacatgcgatacggacacggtgggcggtgggcatcgatcaactggccgtaggtgcatctgggctggaattaccccacagtgcagtgctaagcagtggtgatggaggatattgggggatggaagatattgggggatggagggagaggactagacctctcagtaacagtgcaagcagtacatgcaatacaagtaacacccaccaacacacggaccagacgagaccaaccaactgcacagccctaccaggaaacggcagagcttgtggacacaacagactgcgacaagggacccgctttgccagtgtgatgcaggaaccatactcttttccttttttcggacagccggcacacgagcttgacgatcaaaccatatcggccgagtgcgacgtatccttgcattttttgcatgttggcatggggctggcgtgtgaaggagcatgtgcaaagggccgcgcagacttgtggagtgctgccgtacgagtatcggtgtacgacaaggtggtttgtacaaggtggtttgtaccgtcggacatgatcatctgtaccttggcgtactgtacttgtacaaccacttggtgatcagatataacctaacagactaatcgaccgaggcattcatactcacccgaaccagcctaaacgagataacccccacagttggccgttaggttagagtcttgttcggttcttgggttcttcagcttttgtttttccgctgcccgtcattgtcttctctttctttgtgctccaaacctttcgccagggcctggacggatgccgtattcaaacaggttcatgtatggaaatgactttggatacggccttggatacgaccttggatacgaccttggatacgaccttggatacgacgtcggctgcgattacgtgcagagggagagctacatgttccatgtgcgatgccgtgtgagaggtctgaggactcactctgatggacatgtctcagatatgagttggttatgataatttggtactggccaagaccctggtctggctagctataccttctacctatacatatcttgcgtcagcaatagctgcaatagaggacaagatctacggcgtattcaccgatgcgacggtacaagtttggcgccattcagagttggacttgtcgttagtctggtttggtcgtgtgccgtctattctaatgtctcacaggtggctgataaagcctcttatcgatctaatctagatggtgtgtgactggagagaaatgacgagaggatattcaagggggcggacgattgatgaataccaacttgagctcacagattcaacgcagccagcacttgggtcgcagcgacgacgcagagctcttactagaagggtctcaagccacctttaattagggtgagacagaactatgataacaggatagttgcagaaacaaagggccacacaacctctgctggatagagtcacgtattgaatcgtgcgagcaatcttcggtccgattttgggtgtgtccttggatacttggtttctggattctgtgtttgaggggccctatggcaagtctacggaagggtctagccgtgggatccatggttcctgtgcaagacctttcttgtggtcaatagtgcgataatggggtaagcatcaataacagggcatcaacgccaaacttgtccaagaagtctgccagggtcaaaagaggtgtttgtataggaagattgagagaagagctgtgctagtatgggacagagctgtgatagtatgggacagagctgtgatagtatggggtttgtagaagcaacttctcaagtcgccagttcgactcgctcgatattgagcgatttatggacccaccatggtagctttaaccatgaccctattattgaggggactggccggttctaagaccaaagaacaggaactggatataatagtggtatcattatgacaagtcaaacgtatccgtcgttggcgtgctagacattacactccagtttcaacgtgttgaggttgaaactggagttacttcttacttccggcaactgtacccaagtgaggatagaattctcacgtgagcttacttgactgatgctcttgcagattatgtcttatcggaggccctgcacttttggtgtttcaagaagcttcacaggtctcagtgtatcatgtctgaagactgtctgttttagatcaaacatgctcatttcggtgtatcaaccgtcatatagttgcttctaaatgaaatcaatggtttttaacaggtctgaagacaatgtaatggacgttttcttctcctcgtttgcataattctgggtcatctctatcctgccctgttccatcctttagcgtcctgaattctaattggcgatgtttttcaggaggtgagcttccaaactttacaaggtggaaaataggatgccgttgtcgcggatatcctggaggtgtgcaatcggttgaacttatgtgcttacaatgtgtgtgtaggcggctagatttccgatttttttttgattttttaacagtatatacattcatttaatatgatgtgtggaacccagagactggcaaaaggtcaactaaaagtctaaccaactcagagaatattatatattattaatattttcaatagaaagatcaaagcaaagttatacaaaaggttattctttcacagcaaagttataattaaatgaatgtatatgcagaaaaaaaaaaagttataattaaatgaatgtactgtagctatatgcagaaaaaaaatcaatacaaaagatgaaaaattaaaattaatattagattatttaaaaaatcatggacttggttcatgatggcgcatttgcggaccattgtaggtgaatatttgtagtaattttgtaacagagcccgaaccaacttcaatagtaccatcatacagccctgaagctcttcaccgttcggtatctgatatcctctcgattcaactacagtagctactgtacatacttatggattctcacaactaccgacttgtacagtatgtactcaacaaaacccatgttagaaacacgcgctgtcggatcgaaactcgctgtgtattccactcagctctcatcctggaacggatccatatatggtcccgacaaccgaaaccctagcagtggacttcaccagtcgtctgtcagctgacataaagcctattgttctggagcaagctgagcgagtagggagtagggtatgattatgacgacgattataacgattatgactacgactgcgactgcgattacgactacgactgcgactgcgactgataagcctctcgtatcttctgagcaccacttgtctgtgtttattcagctttcggcgctcgacatgccaatgttttgtttttcaatgtatatattattatgacttttttaacatctacaagcccatatcggaaatcagatagtgtatgtgcgataccgcctgcaggagtgagtggggtacagtacagtacgtcgcatttctggagatggtgtgcttttaacgagacgacccacggcgttcgattcacatgtcgacagtcttgcgcgacaacccatagcgatggctcgtgtgtatgagtccatagaagaatcgtaaagaatcgataatccgcagccttggagtccccttcggattcagccctcggattcagccctcggattcagccctcggattcagccctcggattcagctatctgtctgcccaaccttgacaaaatgcggggtcgggatgcagctcaaaagcataacgaaacagcctcgttcatacccggccacagtacaagtccaacaaacgcgacacacaatcatgcatcgctaagaccgctaactgcggcgatagcagaggtgagggttcggaacgccaggacggaggcaatttggagccgcattatccgcatcatccgcatcaccgaatcgcagcaactcgcttcggccgatactgcatttgccactactgtatcgctcaagttagtttgaggggaccgagaggggaacacggtgagcatggagaactccaattgtgcgattgaatcgattaaactgcaattgcacaatcggagaccgtggagattgtcgggtgacgcacgtacacatacagtatcgcctgtaccaccctacccagcacgtcaactgcagctgttcaacagacgtcgaacccccaccatctcaaagatgacaggagacaaggagacagactttctatcgtttttgaaccctattatttctgcctcttgccttatataaaggtcggtcagagcgccctcttatcatggtccccacttccaatccctacttctacaccagcatcaaacatgacaatccccaagacccagaaagccattgtgttcgaaacctctggaggtcccctggagtacaaggacgtgcctgtgcccgtgcccggcgaccatcagattctcgtcaacgtcaagtactcgggagtttgccactctgacctccacgcctggatgggagactggcctctacccaccaagctccctcttatcggcggccacgaaggagccggcgtcgtggtggccaagggaaaaaacgtgaccacgttcgaaattggagactacgccggaatcaagtggatcaaccaggcgtgctacacgtgcgagttctgccaggaggcctacgagcccaactgtcccaaggcccagatctcgggatacacaatggacggaaccttccagcagtatgcacttgcagatgctgtgcaggcagcccacattccccagggcacagacctttctcaggtggctcctattctgtgtgccggagtgactgtttacaaggccatcaagacctctggacgaaaggcaggagaatggttggccgtgacaggtgcaggaggaggactcggatcgctggcggtgcagtacgccaaggccatgggtttccgagtgctggccatcgacaccaccgaggagaaggagaagatgtgtctggaactgggagcagaggtctttgtggactttgccaagactgacaatctggtggcacgagttcaggagattactggaggtggccctcatggagtcatcaacgtttctgtgtccgagtttgccatcaaccagtctctcgagtacgttcggtccgttggaactgttgttctggtgggtctgcctgctggagctgtgtgcaagtcgcccatcttctcgcaggtggcccgggctattaccatcaagggctctcctgtgggtaaccgagccgacacccaggaggctctgtcattctttacccgaggattggttcactcgcctattcatgtggtcggactgtctgagctgcagaaggtgtttaccttgatggaggagggaaagattgcgggtcggtatgttgtcgataccagcaagtaacatggcgtgacatcgagtttggtacaatgtgaattgacatttttattcatttatcgagtgtactcgaacgttgacgtagtgtttggtgtatggacctttttgaagtcatcgtttcatactatgattaccttcacaattgtgaactgggatatattctgagagaggaccaaaattactctctagtccagttcagagaaggtttatcgtgcatgaaaacttgcattatcgctgctagatgtgatagatataactgattgtggaacgatgaatggtacttaacgatccataaagccttcagcactgtttgtaatcgctgtatcaagtcttatgtttattgaccctgatgggagctcttacaaaatgggtaaccaatgatcagagatctacttctaagaaaaatcgaccatattttcgttttttggagataatttgcggttgcatgacttttgcaaactttttaggggagttccagtgaactggctccatctctcatggttttcagcagattttgttagcgtctttacggtaggcacaagactgtggaagtagagaactgctggagagctacaggtgttaaaatactgagaaactgaggttgtacttgtatcatttaataataactgacaaccacgagattatttcttgtcatcgtcagagattctgccgtatgactcacaagcgtaggtccatcagtaataaccaggcgtttagtacataccagtactcgttaaaatatcagattattcaatcaattaaacactgagactcggaaaataaaaaccctgcgcaacaaccatccggtcatcatcgtttatttcccttttggagctctcttgtggccgtttgggttggttcctgttacagagcccctctgcggcgagacgtagaggggttacgacgtgacgcctgtatcttcatccaatctcatcctgggcaatatagctttactgttcgtcaaagttgccgtttcacttcaacttccgtataacctctcgctttcaccagcaccatcgtaaaactctcagccacttcttttcagcccttgtctctctggcgaaagattcagctccaaatgagactaagacaccatcaacgcctcctttcgagtttgaaaaacagtcattccaactccattgtcaggaaggaccatccaaagaacgccagaccatccaaagaacgccagtattacacgttcagaggcccagaagatgggtgtggctgtgctggctttagatcaatcacatgttttatattgatattggtgagctataataatggcacttcgtattaaccccaaactgttccaattggtagcttcaccgcttctccatggactttggacgttccaaaccctcttgattggcagccactttgcttttgtatatctctactacaagtaaatgtagtcgtagtgcggtgatgggacgtgaaaactattcgtcctgcccaacaactcccacttctgtctactcgggtgacactactctcggtagagtataggtagcacgctcaagggccatccagttccagggccaattagtccattcaacagagtccttgtcctgcaacctacacggcagaaccgcaccacctttatccaagtacatgggtgtactgggataaggcacaaggactttatcaaaaaagtctttcgggaacaggatgggtcccttttcgttatctttgcttttccctatctttgcttttttctgagggatatgattctgtttcaaactgcgtttcggtttggcgccgttggtgcaacgttgagacttgactaaggcaagatctagccatatatcacgcccatgccttgaactgtaactgacttggagggagaacaaatgtctcactcttgaagtctagtattagtcagggtcttcaagaatgtgacatctacttctgaccatctacattcaaacgctcactttacgatgtatagacttgcttactctatgaactgaccagacgacgacttctctggcttttactcggtacatctctcatccatctcaagcatagagtccacgtcgaaggaatcgtgatcaatggactcccgataggcggactcctcatcgaaaggctgctcctgttgggacaacctgatgacggcaaagaagggaccccaaaacaacctgccaattgcaaagaaccaaagccagtaggtcagcaacagcgctgtttggagccagctgcctggagaagtgtccgagtcgtagaatgaaggggaactggaacagaggaggctcagataaccagctacaacagctgacaccgcatgacacaagacattcatgagcttgtagaaggcgctgtttttgttgctctgtcgagaagacttgaaatagtcagttttggactccattttgcgaaaattactaccaaagagttgtagaaatgtgaggtgtggttgaactgtgcaatgtcttctatatatacacacttcacagtctatggcatgctgaacaagagctttaggaaacatgtgtatggacgcaatgacaataaacagaaagttgtcgatgattctacatctacaatcaacttcacatggaattcacgtccttgccagggtctgacaccctgccctatctaccaatgtagtacatttacactgagttgaagattgttgtagtggactttcggagttgtttacaagggagaaatcactttcaggtttaatattgccatagattactcaatgtattgtttcaccaatgtttatggcagagatggatgagatgtggagatttatgggaacagcaatagtggtcatatgagatatgaaagaggaacctctcataaacttcatatgttgaaatcaacgatgataattgaccttttattggtgtctaataaaaatcttcagtctatatattttgaatgttcgagtactgaacgggatattacgagtacagcttttttggtacgggattgactgactgtataaccaactcatggattggaaagttgctatatcatagacatggggggtcagtagtatgggtcaattcatataaacaacatccttgtctaatattaagaggcataaatatactgacgatgtacgacgatattctatgtcaatgtgtttcatatcaccatagcatatatcatacagtgtcaagaatccataatacttggttcctgcgtgcaattaaccaattaaacatctcaaatgaaatctgacatagaatatatagtcccctgtttcatattgtgccatatattagtaatatatcattctgcatagaatactgcgctgagtgaatacgactgttggtgtttgtactgtcgctgtagctgtagctgaaaaaatggctcgtaaatatgagcaattacaacttctcagtgatgattgacgactcctcacaaactccttgatatcaaattgccccattcttttgaaaaccagtccacctgggtaggtttcatttccgattcatcttaagcacatctatgcacaacaccataaagtatagacacgataacacccatgattggtcaacaggggcataaaagtactctttgggccctgctatgttgtatgggagtattaccacagttgtccagggtacaaaaaaaccggtatatatacaagtgattcccccttcaatttccccagcatccgtttcagccatgtctccttccaagtacattgtcgataccaacgaagattcccaggagtatgattttctgacaatgtctgtcccggttgtttcagtctcttttgaggagcttctgtttggcccagacagtctgacggagtttcttccccttcctaaggagtcccctattgactactcctccattgagcccattccctatgttccggagaacggttcccagctcattgtccactcgactaaccccatctgtggcagatcggagttccaggacttcaatcacgagaccgatctctcttgcaccatgccttatgctgcccacgatacccaactggcacatgagctcctgtctcgaatcgcgcgagactatgctaacattcaatgcgagtctgagtctgttcggggcattcttctctccacctatgccaacccctacaccaatctctttgatgttgcggttcaggagcagtctcacgatgacgatgacaagcatctgtatcggtacacctgtggccgaaaagacgacatctactcctctgtgtggtatcgaaatctcattgacggcaacgagcgggatggtggagagcggtactgttccccttgcaaccaatggtacaacactcgaaaccatgcctgggccaaccacatgacttcggttcacggtatttccgccgtcaccaaaaccatctatcctttcccctcgggtgtcattctcggcaagtccaacaagctcaagggatggtgtcccaagtgccaggagtttgtgcatctatacatcaagaaggtgggaacggtgtggaccacctggttccgacatcaggacgctcacattcggaaggagatgcaggaccgtcggggaggcaagatctgcacccccaacaaccgccggaactccaagaagcgatcctttgaggcggttgaggcagttgaagttgaggccgctgaagttgaaaaacctcttccttcgtcttccgttgacgtttccgcttcaaacgacgtgatcaacttcgagttcttgcacaagaaacagcgctttgagatagaggtttacgagttgcctgcttttgaacctggatgcattcagacggactttgtcgagcccgttcagttgattggccttacttctgaggccaattactccattggagaagtccagaacatgatggacatcattgaacaggagatgaacatcaacgtggagctagctcgaaaagaggagaccaagaatgaacacgatatcgttaacgacaatactgaagaagataccggcgattccgagtacagtggaaacaccgagcaggaagacaccgaggatacctacactagtcctgaagaaaacggtgacttcaagtacaaccctttcgaaggacagtttgacaattacgacggtctttttggagactacaacttttagagacgttatttattttatttatttttatttattgaagtacatacagtacactgaataagtattttttctgtggcagccttgaagaggtacagtatgtactgaacatatcttgtacactgtgtattttgatcagatgttcaaccattgagtggactcttaactatctaacaattgtaaaattatttgtcaggtatatactgagactgctttgcatctaggtcgcaaatcgcctatagatattgtaagataggacggactggctacgtacacatggtctagcgctcaccgactcccccagctttgcactgggcagatcactgggcgcggtgttttttatttatttcttctagggaaatacatttcagccgctagaggcgtataaaaaataataaaaaaagcaagttacaccttcacatcggagtcggattcagttgttcagaagagcgcaagacaatcgtgctcgcgtgttcgcgtattcctcctggtccttctcttggatgataaatatattaacaatcaaacaaaacaaataatcggtagtcgtatcagacactgtctttttggctgctgagaaactttttttaataatttttttaataattttttattctaatgattcattacagctatatagccggattattggcgttcaataaatcatacacttctgaatcatagcggtgtgcgctgtgaggcgcatgtaagttggtttgtcgacgcttcgtctcgttcttttctttgtcgtggtctcgtggtagtgaaacatggctaacatatcaagactcgagattctcaattttttttattctattttttatttcggatatagtctcgatctgatcttttcattttcgttgtaggcatcctggccgagcggttaaggcgagagattagaaatctcttggggtttccccgcgtaggttcgaatcctgcggatgtcgccattttttgtattctgtcttttaccagctcttgtctcgtcacctggactgcatcgtctttttttttttttatatctgcatataaattcatttaattacaactttgctttgaaagaataacctttgaaatgaatgtacgcttacacttattttttttttctgcttatatatatatttatatatttacttctaacaaactctgttgaacatgcagtctcgaagtctcagtatatttctatctaagatgaatccgacaattcgagtaacatgcaaagggtctaaaaatatatatatgtttcaagtggaggcatctataataatgaagaatacacttacaatcacacttgatctttgctttttgtaatttttttaacttttttgcaaaaaatgtgttgatcagcttcagaagctaggagaattgaactcccatatattccttgttaagccatcgtcaatccttgagaatttgacatggacaggaattgaacctgcaacccttcgattacaaccaagttgactggagtcgaaagctctaccattgagccaccacatcaacacttgaagtttcccaaaaaagtagttgtccaatgatgagatctgctgagtaatacgctcgaaaaagaaaactcgaagatgttgtacgactccggtagtaaaatatcttgttattttgcttgagttatataatgtgggaacatttgattactctatgatttactctacttacaatattactgattcttttccaagccgattaacccccccaactccagccactatccccctcccagtgtacggcatctaatgcaaactcatgagccaacttcctacaactccaggtcgggaactcgtcgtctatgacgctggtttcgttgctctttttgctgctcctcgcgctcgctcttctggtcagcccagaaggaagatccatcagagagtgaggagttgtcaggacccttgctcgggattcttttcttacgccagttgcgctttactttggcatacttgactttgcgcttgtcactgctgttttgcagcttctgtttctgacgtacttcaggcgattgtgtttggtggggaagttggttggatgcgggaagcagcaaatactgcattgtcttgagtaccgcatacttcaccttgtaatcttcatcttctgctgacatctgtgccacttcttctccaaacgactcggttctcgccaagagaacagagccatccagatttcggacgcgactctcgagcgagcgcaggtacgcgtccacgctgagatcatcctgactttctgacgagttgcaaagagacgtttcaacaactggggaactcatgttgttttgtgtgtcgtaaagagtgtatttttgttgagtcgttcgaactcagaatggagattgctagagtccacactatagctcatgtacattgattgcactttaaataataacttgtcaccataagttttaaataaacacaatggtatatattgtacgttacatctatctaccagtatattcggtatatcttgacattttgaatgaccaaaatgtcaacaaaacttcacaacagcacttggagtgttggaacgacaatgacaaacaatctgtagaaaatccgtggacgaaatatctacgctgaattgtgtacaagttaatggaagcaactacatcaaatggaagctccgtgcagttacctacatgtgcacgtattcaaggtttgtagatagtagattttgagttttactacatttggatggcgctcggcgaacttgatgaaaagtcggataaggagaaaggtaacaataaatatttgtataattggattttttattcgttacaatgttttttcccacctctcatttcgtttgagggtctaactgattcgtttattcttcgtaattaaggttactgtcatttttaaagtacgactatctcgaactttaatatctcaaccgagatgacgagaacttttactagaacttgaaagcccacgtggtggataaaactgcactagtgccgtcctatctggagttggtccctatagatcaagtgtgatctgtattattcctggcagactcctgctgtacagagtcagagaacatccatctcgtgcacatgtgtgatgcgttcgttgagtccggtttccaaaaccacttggtactgtacaatactgtattgtagtatacgagagtcgcgtttcggcattccttagcgacatctgacatttcaaaactagaaaaaagttcaacgtaatcccacacgatattcgcgagatggtgagagctgacagttgtcatctataataactactgggtgtttaccgcaacaaaacccatgggggaattgtgccactgtgccatcaacatactctctactgtatagtacagtactgtactgtacatgaaattgtaggttgtctgtcgggaaacatgtgttatgatcggtgtcaatgaataccgcttggagatgtgtgtgagaagtccttgttggggaaaacaatcatcaagtactgtacccaaaaccatccacaatagaccatctcttacactaacccgacgagtactagttgatttttcttcgtcaccagtggagtaacacgtccatgaccttccatagagtgcttgcagtgcttcccggccgtatccacgctcatattcctaataattgaatcagcaacatcgccaaattgaaagggttggactggaaacattatcatgaacttccgtcctttccgaagcctcactgagactccagatcttttaacacaactcaggaataaaggtctgtaccaacatgctgttcttgttccccgataccagagactttgatccttcgacagcagtcgcacaagttctgaactcaccccttggtcttattacggtagacccacttccactactgtatgtactgtactgtgatatatagctagcttcgttcgtgtgctcttcatttaagtcgctattacgagaaacagtcgagtcataagcctgcactctgacacattgcacaagtttttgtcagacttgctttgtcggctacaggcccattacatctgcttctgctacactgtagtggaaccacattacacttgtcccactactcgtgactctggttaatctaatgtcattaatatataagtgtgggagcgccgcttgcgtgcaagtgcgtctcactgaagtcctaggctaaatgttacattccggcttttcaatggtcggtggtcctttacttcaccgactatctctctcactagaggtgggagaggcagggatcttgtcaaagttcagtctccgtctagcagatcggggaatctggcccagtcgcagtcggttgggcgtcgacggagttcgctccgtgtggtacggcgaatgcgacacctgtgccggagaaggcgtcatcatgtgaagatagtcattaaagttgaagttctgcgagggcgtttgaggagcagcggcagaggtgggctgcacaggggtgcctcccgttccccagccgtgtgacgaagaagatggtcgctgggcaggggacggagaggtggcgagatacatgagcagatctgcgccctcgtctcggttgtcgtctcgagagtggggagccccgagctttcggggcttctgagggggagttctggggggttccagcgatcggtttgccagagctgctccaatagaatgagtgtgggtagcatgggaaggatgctcttcgctcgaatgttgctgctgttgttgctgctgctcacgttcatgctgctgtcgctgctgctcctgatgatgtcgctcctgatgctgtagctgctcctgctcacgctcacgctcgcgtctctctcgggcgtccagctcgctgtcaatgtccatgatttcgtcacgggacagcttcatttggctcagggcacccatggactgcgacttcgccatgggctgtgcctgggcaaactgctgctggaacatgtgctgctgctgctgctgcatgtgcatatgctgctgttgctgttgctgctgcgacatggcaaatggtagctgttggtacgactttgagtaatgcagtcgcggcgatgcactagatccgccgggcgcactggtgatagttcgggcccgtttccgcgtctcggggatcttggcaggcgacaacatggggtagtggtcgagtttggccttgggggatcccagatcgtagagagtggcaggcgactggggaccaccaggtccatggacgcttccggggtagtttccgggagcgaaacggggtgtggagagcgggtggaagggctgctgcaaaggaggagatgacatttggtcggaagtggtcatgtacattgaccgagtggcgttagaggtgttgttggagtcactgcctgcagtggagtttgtgtgtgtagaggtggttgtggaggttgcggagttgtttgtgtttgcggtggaggttgacgatggcgacagcggcttgatttcctcgtcgacccgctgctcgatggtatcaaaggtgaggttgtcccagcctcgtttggttttgtaggtggcgagcttcaggcgcgacttgaggttgcgggtcatgcgggagatttctgcccgttgcagcaccttttctgccgcgtgcgaaatgtcgttttgggtcggtgtggctgccgcagaccccgcggtgttggtgggcgtggccgagacgctgtggttgtgggggggagggggtggagacatttgcatggatgtgttttgtccgcccaagccaggctgtccgttcatcgccgtctgtccgttcattccaggctgtccgttcatgccaggttgtccgttcatgccatgctggccactcatgtgatggtgaagttgctgctgtccatgctgtccatgctgtccatgctgtccatgctgctgttgcggcggaaacggcttatcgccccgcatggcgttggccaccacctgggcggcggcctgtgcctgggcaagagcctgctgctgagcatggacctgggccttggagtgcgccatgtttgcaggcgtgtacaggtgcgagtcggtgaccgtatgtgtggagggcgcggacgagggaggaggcatgtctgtgtgtggatgcgagtggtgggccccgtggtgaggatggggatggtggtggacggcgttcatggcgagcgcgagactagagacgaggtgttgtcgacggtgaatgcgtggccagagagatggtgcggtgggtagtgtgacgactaaagagtttattgaacgcgacagggagtgtccaacctaaactgaggcggttggagcaagttatagcagtggagaggggagtctgaaaagcgattccgcggcggttctggctgtttccgtcgactctactgctctaagaccactccttatcttctccatcgcccccacaaacgccgtctacatcactgcgctctatctttacccggtcgtcggtggtctacatagcaacatgcacatggaggactcaagaccatcgtttgtcccgcacctttgaccgagatgcgcgcgagcggtattttgcaaatatgccgctcgcgacggtcgccaattgtctgaaaaaagtgccattttttcatatttttcccatttttgcccgcttcaaaaaacaacttttcactccctcctccccccatccctggcttaacctaatgcccagctccaaatctacacccgccatcgaaaacgtgaccggtgcagcatacacgcaccagtgacccgtttcggagcccccgactgccacacggacccagacctccactccagcaccaccaaagcccttcaaaaacactgcttctcgttgtctcaagtccggcccctccgccaaaccctattgtcggtgccttgcgggccgctggcatgaatatatccgggttatgaacccgccgagcccacgacgggtctctccgcgtcgagccgatgccatacgtatatcttgcgggcctggagctcgtcgggaagccccgtttcaaaggctccaaaaagtcgtgcaaaaaaattgtccagcccattgactaattgggaatcaagggatgtgggtaagggtgatgtgacgcgttttgagtttgtctagtgggcagagctgaatcggtatagctgtgagtgccaggatacagcagtcgcagtcgcagttgcagttgcaagtactttgtagcgcaagtcgggcgttggtagtaatgtgcttgaacacaccttcgctgcacgtactgtaccatataaaaacatattataaccgtcgacatatgtacaagtacgatatggtacctgcacgtcttgctgcacagggacttcagacgtgtgtctggtgccactccgcaagatgatctgcttgtgtacaagtacggctgtgtcattgtacttgcttgcacatagttgtagtatattgtgtagtttctgtgattaattgcgtacaagtactacaggtactgcccaggtaccgtactgtaccacacaaccgctcgtgtctcgccttggtaattagcgtgttccaactggcacaggcacaccgggctcgcacttgcctaagtatataaggggccctgggcgccctggaactccctcttttttgtctcactcttatatcactcttttgtctcgctcttttacacgctttatgtttgcaccctactcctgcccaactccaccttggccgggactctaaaaccaatatgtgctgcacgcgctaatacagtatcaccaagcagcgcagctcaacgggtaatattcattgcggcttttgtcgtatgcatcgtacgtgtgtcgagcaactaagagagacgacaaaatttgcaaaaaacaccgccaacagggaccggatatacgtcacgtgaccacccccccctcccgcaagcgcccgcgcccgcgcccgcgcgtgatccgcccacttctgtcatggccgaccggctccaaacacccgtcactactgtttcagaaacccagaaaaagatgggacccacgcgtcttgtccgaaaccttattttcggctggcgcttgcttctttgggtcaagttgcggaccgtcgtagagcctcgccaggaggtctccaaccggcgtaaacacgagagattcggggcccaaacaggatatattcacatgttcaagctgccagaatacccatccaaaacctcacgaaaatcaaccgactccagacgaccatttccaagcccccaaatgtcgcatccaccctatttggtacgtgctaaacgctccaatacactaaacgttaattccaagagcgaacaccgccaaaaaaaaaaaaaaattatataagcgtcgtttccagcgcgggagccggcgatcacgtgacgtaccgctggaatcacgcgacgtttggaagtgtgggcggtcttgttcttgtgaaacagtcacgtgatgtctgtttttcgtttgcggcgtcttttttttttggttttgaggaggatccacatgcagttatgaggggcagttatgggggtccttgtatcatacaagtattaccatgattgattgttttgcacaaacggacatacactggcgttagtcacggtgtcgtcggtcatggtgtcgtcggtcatggtgtcgtcggccacggtgtccgtctcatgcaacagtcgtgtgactggacgctcgtcggcgctatcttagacgcttagtccggctacattggacgacattgtcgtctagaggtgcagtagcgccacacgctgtagatgtgggggagttggagtggggatggatcaagtgagaggttcagtctggtggtagtgttcgagtgcgagtgtgagtacggtgccccttgtagtatgtactgaatgtacgagtgcgcactatacatacatccagcagggcagtacatacaatatagtggtttgtctgcccatgcctgccatggggtctcaccaggtctctgagatactgtactgtcgacgcagacgctgtacagtagtacatacgatacatgttcaggttgtatcgttcaggttgtatcgtaaaagagcaagtgtacacaggcaaggacaagtcctcagcgtcttatggctatcaaaagctggtttgtaggctacctgtacatacgatgcatgcgagtacagtacttgtacaatacccataatctatcttgatctcctcttggagaacgacctcctctccctattgtggccattagaccagaaagtcgagcgtcttagactgtaataatctacaataggcagtctggggtgcccaacccgatgcttcgggtatgaagtgtcgagtctgaaagtgttttgtcaacggttggcaggtaacacacactacagtagtacaactgtctctggtttcagtggaggaggtgcgagtttgtctgtacaagtacgggatcctttgcgtgacttacaatttcgttaccgttcagtttactgtacgttgagaaagggctacatctctcgaatgttggttgcacgccttctgctcgcactacattcctcaaacaccacggtctatacttccaaccgccccacaatccatctcccggtggccaagctggtttaaggcgcgagactgtaatggaagcatttgtaatcttgagatcgggcgttcgactcgcccccgggagaagcacacgagcagtgtctcttttttgtcaaccatcatgtcttcacatcagtataggtacccaccttccaagagttgagagctattctgagcagctttgactgcagatatttgtacaggctggtgatgattctcttattgtagcaccacactgtactatactgtacatactatattggtactcgcacgaacgtcatatctgttcaaaccaaggtcctccgtttatagcagtgtatatacagtggcatatacagtcaccgccgcagctgtgacccattgcaaagctcaaccactttggtgacttattgaggaaattcccattgtctggacgtacattacggctcttttcccttctccaatatcctctggaaaacctgttgaagccgaagatagctgatgctgtgcaagtacgatatgtgaaagtacctttacaggtgttactctctgcgaaataaaagtcgtacttgtacaaacacctccaggttcacgtgacgccaacctcagatttcatttcatagcattattttctatttttgatatttcattttcccacaactgaccattcaattctccatagacatagacctgcaattttacttgcgcaatgatcctctgtcagaaaggttttcacaccgaaaatgcgactgaatcgagcccaaaagagcaatgttgattgaaaaacaaaaaagaaacaatttcatgtcgctacaatcaaaaagagcaatgtatcacttcgttttcgagcaaaaaaatagagtggacgagaccgggttcgaaccggtgacctcaagcatgcaaagcccacgcgctaccactgtgctacacgcccaaactacaaaatcaagcccggattggaaagggggtatcgatcacgtgattactaatccgcgcacaaatatcggttaaaaacgttccgtcggtagtcagagcaagtcagatccgatctatgatacttataaaccaagctatctatggggtagagtcgtgtgattgagtttccagtactttattctgtactgtccatactgtaacaagagaagaggctcaagcagcacgaatcttgatgagttgttccgaattgaaagataccagatttcatgaaaaagtcttgaaatatcgatagataatcaaaggtgtactggatcatgaaccttcaaacaatacaatatgtacatacgtctgtctttcgatacaatataggcttaacatggcatacaaaacatgggtgagtagcacaacataaagagacaccagtgatgcaagaaaaaagatagaatgatgggaatggatcttcgcatccataaactgcaaaaagacaattgcagcacccaggattctcgtatggtctcccactacaatactaactgggctctctggtgcttgactatggctgatcggacgggaagccgtattttcaccaggatatggccgcaactgacaagagaagggagagatccgtagcaaggcgtagttcgagtcaagtgaccctaatgaatcattagaataaaaaaacccctcagactaccaccatggttcggtctcctttaacagtcaaaacgattgtatggatgattctggagaacggcggttaaatgcagttgtagagattgtagtgctctgacagaagacggggggacttcaattaacagatggaaaagctctttaaaatcaaatgagacactttttgtagtccttatttctggctatcccgttctatcatcttttcaatacagaacttgcaccgtatgtacagtatgattgcgactttgaaacaaaaactacataggagcctctcaggtgatctttatgaaccgacccggcctatcggttacaacgatggaccacgctggggaacatctcagggctggaagttgagtactactgggtgctactccaagtcacccgtcctaacctcagctacagtatgtacatactgtagctgaaatgtattgcactggaaaaaaggtcaaacctactgaattgattagaaattagtcagggaggatactccagaccatcagaagcccctcggaacatttattttatatatacggtaattggtgattcagatagagcgttccaaaataggggttacccggctttaaggaataaatgaaaagtgaccaaaaatagcgattttcgataaaaatggacgataagggggttttattactgattttgtgaagggaaataatcattttgacatgcccttgtacttgtggtacaagtttattgattggtataaacaataacaaaagtcttatttatctgtctcccggtcccaaaaatccaactaaactatcaactatatccaactaaatattacttggtgaaattgcaatttgaacagacattaagaccatattttgcaatcttcgacgtagtagtttttgacaggcgatttgtttgtctaaaccgagccaagggaaataacagacattttcagactcaatcattcttgttgattcgatgacaagtcgtcagggtctgactttttttttttttttttttttttttttgtttatgttttttttttattttatatattttatatttgtttacatatgattacataatccaggaaggattgatccgtaaaggtgcaagcaaaagcggcaaaaacaagcagaaggagggaaaatgaagttcgaaagtattcaacagacatacaacatggacaatacgtcacgctgaccgtttcccattccagtaagcaccgactttcgtctctctgtcgtactgccttgttaggtaaggtaactacagtattatacggtacagcacttccaagctagagataaaaaaaatgggcatttcgaccaacccataagcgggtcgtattgtatcggtattaggatcgatacaccatataaaacgactattgacatccacatggacacgtgcggtcgctcactacaagcgcgcgcgtgcagcggttgcccaactctaacatcgaaaaatgagtcctgggtaagttcattatgtcagccaaaagatcgcgacaacagtcgacacccgatccaacaagtacagtacagtattgtaccgcgcaagaagaacactgaattcgcgacacaaacacacaccatcatgttatcgataaagaacgatggaacatacacgacccatggaaaaacacatacgatagcccgatatgccatgttctgtcatttggaacgcctacagagccgcagtaatcttgtggagggaccacccagcttcagagacattccagcgagactgaatgaggcccagcgactggcttggaacaacaaagattcgtcgcgacctctcgacaaccagcaggagcagctcgtgaaggaattcaagttcatctgcgcaccgatgatctgcgagactctgctgctcaatgggcgctacaaaaatctgcaaacagcaatcttggattacaccatggacgagtggctggacgcaatataccagactctgtcaagggtgattccctggtggttttactacaagcacaacatttttgagatctcaccgggcgccaagatcaaccatgtgcgtctcatttggctgtatacatgtattgggcctcgcaatggcattcaggaagagaaccatttggattccatcgcaaaatgcgacttggtggagctggcgtccgagattgactcgtctccgcccatcactcccacggatagatcgactgaaaagtttgtcaactcccttctacaggtcttggaaaagaaggtacccaatgggtatttgcatactctgttccagccaaatttagtgagagtcattctggagtattttggattcacgtcgtgtctggatttaaggtggttcttcgaagtgttccgagaccgtgaatctgagcttacaaagtggatcaacatggagcagggggttttatgtcctcgaggacgagcgaggtcaatcccaaaaaacatgatgcctcacgacattgccaccacatttaacggtctcacagcagccttcatgggacagaaagcctatgtgcatgaccgggacttgtcgttaccgcaatgtctagaaaaatacggtgttctgaacgactactacaccgcagagcaattggaagcactccatgaatacgtcagagcaacatcgaattatgttctacaccatcttcgagaagaccaagttgaagaagcagtcgaaatgatgctgcaagatcttgagtgtcacccgcacttgacattctcactcaaattaatgaagagtgcccgtgtattctccttatcacacctgactcgagtagtcatggggcatttgagatacgtggaagtccgtttggagttctggcaaagtcgtaccaccgacggggaagtcgtcaccaagcctgatctctcctgcgtctttattgtgcctaatacaggggacccaatcgaaattgattccgaaaacgagcaggacctagctcctcctccccttcccccagcccttattcaatacgaagacaactcgtcgaaatcgcacgagattgccaaaagaaatgcccaaaagtggatagtggcatcaactaacgcagtaacagactatctcaaaacctttgagatgttgcgagacacaaagctgtgtcgtaattgtctgtttagtcgccgattccacttcaatgttggccgtattgctcacgatacggcgaaatgctcgttcccgaacctctggttcgccatgagagactcggggctggattcggtagactttgatttgacaccatcagagagcttgaacaagaagagtctataccagatggacaagataagacaggactggcttcgtgcctcggagaaggaacgacgtgcgtttgaagagatgggtacccagatgcccacagacagttgtaacaactgtctgtttcacgaccgagacgccggaggagggtttgctatcatgcacaaaactgaggcatgcagatacccgaatctttaccagcggttattcgacaaggaggcatatccttgggatcccatatcgcgatgatctggggaagcccgttgaactgcactcgagagctcgcccatgcattgtggcagtttgagcgaaccatgcgaagcactggcctggtgggtactgaccccgtggcccagcgaagtttcgctcacttgttcacccgagcatctgcagcatatcgtcgtgacatgttggtcgtgccgagcgtcttttctttttaggaggattatctcgatggctggtacacattacgtacagtacagtatgtacctgtgaggtctgctcacgttacagaatcatgctgccgactctgattggaaaaaaaaaacaacaaccaacaaacaaaaccaacacccatagaccacgatactcctacgtccactccctgatgccgcaacgactcaatcatgatacacatgacgcttattaacgaccctcttgctaatgacaccctttacgatcctcacaacaaactaagccaacttttggatatgatttgatttgttatgataagattgactgattttaccagaagtagtcttgttgaatggaaaaccttgacgtgggtaacaaaccactacaagtacagcgtacatactgtagtttccattctgaggggcaaattcactcagccgaatttgtcaacctgatggcgcgtgtgtgctcagtcgaatcctccactagggtgtggagactgtccagatgagtctctatgttagagagaagagtctggtgcatcggaacgcattcacaacaagtgatatataagtcgttaatgtatttgtaattcattttattcaacaagtcttgattcaccaccacgagaccgcgaaaaaaacaagatgaagcgacaacgaacccactgacacacaccgaaacgcacatcgcgatgaatagtcgtgtgtataatttattgaacgccaataacccggcttactacaagtaggagacgatgaggtggctgttctatagggactcggagtcaacttttcgacactccaagactgaatcaccgcccatcgaccctgggctggactgcgaacagttgcagagagtcctccacttaggagcaagtggagaggactcaagactacccctggctgggttagtttcgatgcaacggcgaggctgttaagatttttagagctgtagctgttgtattttttttggctgccggctccaagtgacaccaactcaaggagcgagcaaagaggctggagaactcaccgtccgtaaagctctttgcttataaagaaatgtagcgggagaagaatatctccgtggctgtcgtagatgtgttgtagatgtgttgtggatgtgtcgtagatgtgttgtagatgtgttgtagacgtgtcgcagatgatttgtagatgagtgtcgtaaagaatggagtcgtgggaaggaagaggaggctagatagcatcttcttaataagatgagtgtacacagttatacaatcaccttatgtgcatgtgccaaattactgtaaacggaaaaaaacatttaaaatatacaaacccagtaaacgaaattataaattcttatttctatgtatagtatacatatattatactatatatacacacagacagatgaaacattaaggttgaaattgtgtcgatgaggtgcattatcgaaactctgatagtatatcaacgattacaaacacgtcctgagctgttgagggtatattaaattcgcgcgttcaagaaaatgtatcttacatatgtctatgacttttaaggggaggggggctataaaataatctgattttctatgacgtgattcaatcgagcttgatttatttgatgatttcatacagccagtaataaaatattttaataatgtttactttgacttaaattaatatttatattaaattgtaattcgactccagatgttagggaaatgaatataatctgagagataccgaaacaaccccagaaaataagagctggaatcgctaaacggaaccaattacggttcatcttcaagaaccattgatatcatcagacccggtctcattgacatggacttgtagacaagcatcaatctacagcctacagtatatactgtgaaaaaacttgactacagtccagtcaaattctaccgcctatataactaggctacacaatatctgctcgatttcttctcaattcaccgcgttgtgaaccatactgatacgctctctacagaaagtacgcgtttcaccaacgcaagaagtagatctgtctaccaaaggggatggttccggggaatcattcattatcatttatataagtacaaaaagaaagggttcagtctgctcctcaacttacataagggccacaaccactggaagagccagagcagcagctccaacaacagccttggaagcaccgttggcctgcttgggaatgttggccttgggctgctgaagaggggcccgagtaggggtcacagtgccgttgttgttggttttggggttctggacagacttggggccggtctcggtaccattacccttggcaggagtggactggatagcggagggcttgggctcagcggtcttagtgcacttggggcagacggtcgaagtgacagtggacttgatgtgggtggtgacggtggctccagctgcgtcggtgctggtgacagggcagttggtcacgtaaacagtgacatagttgtcatcggggttagtgccgttgattccgacacgagcaacggagggagagtctgcgagagtgccattggcaacaggaagagttgcggcggcgatggtggcaatagcggcgatagcggcaatggagaactgcatgatgatactggttgagaggtctggatgtgtcgatatcgtacaagaaggtgtatatataccatatgtctagtctgtgagggcatgaagcacggtggaatgcagaccacggcgcgaaaaacacgcagatgcgtttcctgtacagtgcggttagtcacttggagatgtgcgtgttgattagctgggttggtgcgtttgttcactagagaagttgaaatgtgctacagctggggatcatctacttatacgtattagacaagtttacagaagctgattcaagtacaggtttttttcagaaaacatttagatgtctgacagaccgttgcgccaggttcataaaaaccagttatcgtctattacaatagagcgaaaaagccgttgctggagagtttaggggactaatgcaaaacacgacttagcgtcatctgcaaaacacgtcgtagtggtgctaattgtggagccacttgttggaccagttttcgtcgagagaaacattgccgaagtgggaatgtagccatgttgaagatcatctaccaccaagataagggtggcatctggatctcgttcatgaaacaagacagcaaagttatggatgattcaacgaaagaagtcgaagaggactcttctttgactgatctccgacccctgtctacggttcctgaaccacatttacgcttgtcaggatatggcacgcttaactggagcatccgggctgttggaacaccttccaggttgcagtttatatctcgtaatttcaactaaattcgtctaagacctgaaagtgagatcgattgatacagagccctctagtccctgcactaaaccatggccaggaatttaccagagctcgttggcgggtctcggaatctctctaggagaaatagaggggaggaagacatgtgattgagtaggcgatcagagaatcagagaatcagaatggagcctgtctggcaccgcggcagaaagggacacatacggtgaaattgtacattctgaactactgtacttctctagacggtctaagcgagagtctaggagacagtctaagagttacctgaaagagaagagaaaccacaggaaaccttggagtcagggttatgtaataacatcgtcatgcagtggcctgtgtccattccgcagagagaatggaggccattagtttgtatcttacataattccggaatgcagcatgtctacctatgagctacaatctcgctattgtagttgaacgagaccctggaatgataattacagtacaatcgagttggtataagagccgcggctggctagacatctaagctgaactgtacaatgtcaatgtattcaaacagagatagttgaagttgagtcacaaaacttttacttttaaggcaacacgtgtctgttgacgtgctgctatgacgctacagagagtgggcacggcaagagtactttcggtagcttcaaacatctgtcgatatggctcctgtagccaactccagttatgagacaagttcaggtaatcatactaagccacaatcgtaatcagaaaatgaacttctagttccgtttctcccgaatccacaggtccacctcctcatcccccagcttgacggttcccggctgttgcttgaaaccaaactttcgggcaatggctctagagggctcgttttccccgtggtcgatgatgcagcagatggggtgggtaatcttttcagacgcatcggcctccttgaaaatggccgtcagcgcctctgtggcaatacccttgccgtggtacttggggttcacgacccagcccgcttccggcatgaggggcgagtaggccgggtccgagtctcgcatgaaatggttggtgccaatctctccgagatactcgcccatctctttaagccggaccacgtaacagccgtatccgtagtgatcccagtgtcctcgatggtacaagagtttggtccagacggtggctcgaggtcgggctcctccgcagaacttgaccgtctcctcgtcgttccacagagccaccgaatcttcaaagtccgccaccgtgtgtcggcttagaatcagcctgtcagtttcgattgtgtctctcatttgctgctgtgtcgaaaaatggcacggcacaattataattgaaattcagttttatttcaagatcatgcatctggctgcaggcttgtgcataagcggttacaagcggctgaagagtcacgcgatatcgtgtgaaagggatatatcgaggggttacagactgagtcatggactgtttgatgctgtggaattgtgagttttcaagaaaatctccaaaaattatcgaaattcctcccttcagacaacatttacctcattatgaaatatgccggttgttcttggcatttttcaaaaattaaaaatggaaataattattaaaatacacaaaataatgggacacgcggagaggtagtcaaaacaaattggtcgctagcaatgaatggtcttaagcaacaaactgtacgttttagcaaacagaacaatgatctcgtgtctcatccttgttacaagtgacaaggccaatcagccccgatctcgtctagaaccgaaaccagctgtttgagtcacacatttgaatgaccgtgatgatatggagtcaggatcaaatcacgtggtctacaactggaaacacggcaacttctctctggatccaatcaagaaaatctggagccggtacagtataataaccctactcttttgcgacttacacagcatcctatataatctacagaccaccgaatctatctgtactcgactaaatttttactcttatatcccgtactaaatacagacaaccgtcgatcaaccacatgcacacagcaactgtacatccatggaagacaatatggacacgaaccaccaatagttgaggtcaccggttccgtccctgcacatcatccaaccttctccaaatacctatgcttgaccgttgccactcggtcaccaaccagcttgctgaatatcctcgagacacgtgtcactatctgacactgagaacagagcccttcaagcttctgatttccttcttggtctcgctcatggcggtttcatggcctggcaatccactcttcatcatcgagtatcccgacatggccagctgatccgagtaattggtcagctcctcaacctggtacttgaagcccgacagcgccgacagatcactcacctctccggcgtgcttgagtgagtcggccagtcgctccagattgtccacgctatcatcaatcaacttctgctgcttttccttctcggccaacttgagctgcatgggcgactcgccaaacgacacgtggctgctcttgccgaggctggggttggggatatcctcgccctcctcatcctcggtctgtgtctgagcatccacaaatcgttggccctgcaaagcccgcacaggcggaatatagctagccatagatgacaatttggcgttgagctgctccatcagccgacgggcatgtatggcgtactcacttcgcgcaaacgtgagctcttcgaaaagcgggttcaaaatggtcttgctgatgatataaataagggccgaggtgccgccaaaaatgtacagaaccgccaccagctgcttgaactggacggtccgaggccggttcatctgcttggcaaactcgatttcgaaggacgaaggctccggaaaggcgctcatcgttgtgtgtgtgtatgtctagtaactgtgggggtctagtttgtgtcactgctaagatgcgcagtgaagttttgtcggtggcgtcgtagtcaacagggcgtttgcttgtcgtaatggtcacgtggtcgcttgtcgtggtggtcgcgtgatctggtgtcgtaatcggtcacgctgttatgttcgtatcgcacttggtgatctgttaacggggaggttcggcggggtatgcatgaacatgaaagaacttaccccagttggatagagatccgaggctggcacgtgaccagcacgtgactggaaaaggacaaaaaagggcaaagcaaatggctgaagaaggcgacaagaatatactacagtcatgtgacctggtaacaactccaccgctggctcgacgggaggcgcaattacataagcatacaaagtcacgtgatttaccgaggcctgcgaaacctaataattcgccatataccagcaaagcgacgggtgaaagacattacgtaatacacaacggctgatacattagtaatatttcgttaagtaatatatatctgagtcagataattatttgagtcgttctgaaatgaatctgtaggggaagtacaagtacaagtacttacagaacatactcgtactcgtatcacattcggcgaaatcagatacaccttatgagtttacaaaagtcatgaagggtaactggccgtctgaagaacaattcgcactactgttagtcataataagcccgtttcatggctctgtatcgtttcagaaagtagagtgcctcgagctccttcttgacatattctccgagtttgatggcgttttcaatctccttgggatccgtcaaaccgctcttagccttaaacaccttatgacatcggtctcggaagtatttgtatccttggggataatctcgtcccatccatagcagttctttgtacagttgtgtgacctggggtttgagggcctgttttgctgacattgttggcgattgtgattagtaatgtgattttcaattcgatttgtaatgctgaaagttgattactcagacaattgttgttattttgctgctgtttcgaggtgctgggctgttgaggggtgttgcagagagcaatccggggatctggcgggcgggatgtagttgtgcatatcagatgcatgttgatttggggatagggttaacaatgggaataaattactaataaattgaatagaagaataaaaaaataaaaaaaataaaaaaataaaggaataaaactttaaacaaataaataattactaataaaattgattacataaagattaaaacaaggagatatcctactccaagaattaaaagaaataaataaataaatcaatcatcactcctttgtgcgcaattttagtgcgcaaatgtcttcattattatttgatttcattttacttcaatatttaatattgttaaatccatgcgactcatctcccaactctatgcttatcaaactccgggagaggaaatttcatgtcatctaaaaccacctggagatggtaaaaatgagccaattttggtgttaatcgacccaaatccatccaatatcacatcatttgtcattttctggctcctgacactcacaaacccatcaattagccgcccacaaatgccaaacaccgcggcatgcacggcaccaaaaccctggaagtcgattaacacgataacagtcgatccccaactccttctcatccgcaccaactctcaaaatgacggacctcgatgtgtccgtgtactcctcggaacaactgcgggaatcacgtgattcggaaaactacatgacgttcatcaacacgtgcttcggaacaatgcacacgaaataccattgcttcgacacgccccgtttcagcaacatggacgagttctacgacgacttcaaacacccgggatcagttctggccgttgcacgagagcctggatcatgtgatatcgttgccatgggcgggtatcgacctctggacgaccacgagactgctgagctcaagtgtctgtgtgtcaatcagcagcgagcgggtgagggctatggaggtttcatgaacgggtatgttgagaaactggcgcatgacaaggggtttcgaaagatgaactccgttgtggtccgccagcatggcaatctggtggagttttatcaaaagttggggtacaagaaattggaggagaggttgttggtggctggaggagatgatatggggtttggcaatgtcattgatatttccatttggtttatgcagaaggatattactgcgtgattccaacggacctctaccgagcagttgtatcactacagctgtatttcggagatggtattggtatgagtatggtacgagtacgactacttgaagaggtggcacatatgagacatgtgatacaaccaattgcatcatgtgacgaaaccaactgcagtacttgatttgctgatcttcccaactgcagtacttgatttgctgatcttcccatctcttcttccaactcctctacgtctttggtaggctatggttttgacgagcttcatctggatagccgggtcaatgtcgagtggatcagctgtatgtactgtcatcatacgagtacatctcatcaattactgtcaccgtccgagtacacctcaatgatagctactgataccgtttcaatgagacacccttctggccatcgattgtgatcagagctgtcacccatgatggtctgattcttaactgaaataatatcaagtagatccaatttgtagctgtgacgaaatgatgacacatgttcgatcttgatccactttgaagctccagatcaaatcgcatgttcgatcttgttccgttcgtcttaaagtatcctgttggcgatggcttcactacgctgttgacaaagtcatgtcagaagcagagttgagacagaaattgatatgtttttttccgtcaatcaatccaattcccagtaaataatcggtccatcagtttttttcgagtcatcgtctccaaaaatcccccaatcacggctcttccgttccgataacgattctgataaggttgatgcatggctgaaccggtacttcacttcacattcaatcacactcactcacatggccaatctgtcgataacggtgattccgtcggcgcagctcgtcgccagcccccagctctctacctacgtcgatttcatcaacgcgtgtttcggcacgggacacaaacgattccattgcttcggagcggctcgattcgtggatctagacagcttccgcagcgagttcagccacccagggtgcgttctggcggtcgcacgtgaccccaaagctggcgagattgtcgccgcaggaggatacaagccgaatgacgacggatcggtcgacctcaagtgtctcagcacagccgagcatctggagggaacaggcatcggcacgtatatgaacacgtacattgagaatctggcacgtgaccagggattcacaaagatcaacgctgtggtggtcaaggaacatggagatttgttgggcttctacgagcgacgaggatacaagtccgtgagacacgagcggttggacgttggtagtccggaagttggaggcaagaacattgtagagattgtcttggttcatactcagaaggatttgtaactgtggggcggattggagaaatgtcaattggaagttgattctgatgatgccaggaatcaacggtgtgagtagaagtaactgcaatctcttaccagaagttctaccgtacagtacgagcacgagaacgacatttccggcacaagcatgagtacaagtaactaagcaatctcttaacaacacacaagcacaattactcgtactcgtactgtactcatactcgcactgctacctcccttcgtgcgtatgcactggtgcaacatttgcaggtctctcgattcataggatcgacaaaaaatggagccattgacgaatgaacatcaccatgaaaatcagcgggtgatatttaccgcaaatgtcgaaatttcacacagttttgctctgttctgagcctttcgaattccccatcgactcacatcagggacactacaagtgtcaatgtccagtgcacctaaaaacggatctgactaatgggatcttccgcattacccgctgatcggagtcgaaccatgtctctttgatgtcacacgtctgcagggacgctttgattagctccaatgccatgttgcgttgacaaaaggtgggcatgagacactcgacatgatatccctggaacgacaccggttcgagatggactgataacatcaattggcacgccacacgtggagagccgcctcagataaccaactagcgctgtctgtcggaccgaggccagcccaattacacgcacaaaacggcactaaacgcaaacccagaacatgagacaagagtgagtgagacagggtggagaaatgagagatagaggagaaggaggagacgagaaatgtgaccatggcggtggagagaagaggaaaaaagaaactacaagtatccagcacaaggagacactgctgagacattacatttctgtccaatggggtgtgatcgacaactctgtttcactagcctaaacggcgataccgccttgcctgtcttgatcacgctccttgtcctctgactcaagtcgcaactcctttgttctggcccaccatggggtatatatagggtagccggtgttgttgctcatgacgacaaccgatttgacatgttccagctattctcgatactggtgctggctttcacaactgccctggtcgcccagctggcgtataaccagtacgactatcaacgcaaggtcaagaagtttggatgtggccagctccgtgtggctgaaaacggactgtttggctggaaaggcctgcgagaagtgctccgtatcaacaagtacaagttgggtcctgctgccttgaaggaccggtttgaaaagtacggcaagacgcatgtgttccacgtcggtccgtctcctctcatcactaccatggatccggagaacatcaaggccatgttggccacccagttcaaggacttttgtctcattgccagatacaaagccctgggacccatgcttggagacggcattttcaccctcgatggacacggctggacccattctcgggctctgttgcgtcctcagtttgcaagagagcaggtctctcgactcgattccatcgaacatcactttcagattctcaaaaagtgcatttccaaggaaatgagcgacaagagagacacacaaagaggctttgacatccaaaacctcttctttctcatgaccctggacactgccaccgagtttctgtttggctcgtcggtcgattctctggtggactttctcgacgatccttctattcagactggagaccacggagggattgacgaggccgcaagaaagggcttcagcaacgcattcaaccgtgctcaggagctgagctctctcagaactcgtcttcacaagctgtattgggtgattggaaccctggctgtcagggaaccataccaccgatacaatagagaagtcaagacgtttgtggaccattacgcagccaaggcgattaaagcccgcaacgaaaagaacaccgatctgctcgataacgacaagtacatcttcatgtatgagctggtcaaagagacctccaatcccatcaccctgagagaccagatgctcaacattttgctggctggaagagacaccaccgcctcgatgctctcatggatatatttcaggcttgcccgtgaccctaagcgatatgccaagctccgagcggcagttctggctgactttggaccgggccccgagaatattacgtttgagtcgctcaagaaatgcgactacctgcgatacgtgttgaacgagtccctccgagtgtatcctgtggtacccatcaatgctcgaaccgcttctcgcgacaccactctacctcgaggaggagggcctgatggatcacagcccatctttgtgcccaaggggcaaaccgtgtcatactcagtctggtggacccaccgagaccccgaattctggggacaggacgctgaggagttcattcccgagcgatgggacaccaagaacggcagtattggacgaggatgggagtacctgccgttcaatggaggtcctcgaatttgtttaggtcaacagtttgccttgactgaggtgggatacgtgttgagtcggatggtacagacctacgagacgctggaaagtggagacaccaagcccttgcctccgctctacaaccatgccttgactctgtgtcaccaggagggcgtttggattaagacggagtgaggcgtgactgtttgcgaccagaatgtcaactacatgtcaatgcacgatttatctgtaatctctgaatcaattattctcactttttataccggttgatacaaatcgtgacaattgcttgctgacggtggctgggcggattaatgatggttgcaagaagtgcacatcttcaaaccaaacatgactcaataattatagtacaaaaaagcgactttcaatagtttttgcgaaaatcgcgcttagtcagcactcgtaacaaaaagatgatatccgtgagattcgaactcacgcctccgaagagaccaggaaattcgttaaggtattagccttaacctggcgccttagaccgctcggccaggataccattttgtgaaaaatttgttttcttggtcactatgtttatatttctgcttagtcatagtcgcaacccgaaatacaaaactacgaaacgaagacgcatttttataacaaataagatgccaattcaatggcacgataaaatacactataaatactaatacttaccttctatcaacatggagacgtagcctttgaccttgtccatgtttctatgcaggccgtctaacttgtcctgctgacccagctggtgtagaagctcctcattcttcagaccaatgacataggcccacacacagtctgaagcagcaacagcagcttgaagagacgactccatggctgcagtcttttcggcaatggtgtcgaaacggtccacgcataccaacgaacacacgtacgacagctgctgggtcattcccatgttgagggctctccaagccttctgcatgctctcttggcgctgaagaagcgtcgtgtctggtgagttttgcaccagctggatgatttcgctcatggcattcttgaccacatgatgttcgtccggcagttcgcccatggtctgtcgcagagcattaaggttctcttccgacggatccaggctgcaaatattaccaatagctgcccagtagattccgtcttgcggcgagatacgacggtagtacccgagagcgttttcaggtcgacctcctgcatgtgcgcctagtcctgcaacgagccaggataatgactgtagctcttcagcttccttttcaggcagcttcttcgacagggacacaaacttgtcgagcgctcgacggcccttcttgaatgccaagctgcagaactcgatcaacgacagatacaagtatgctgtgcactgcagcttgagctgctgggtcaatgcatcggatacgtgagagaaggatgatgcttgcagaggagcttgcgtatcgttgtctctctcggtaagtcgaatgcacgttttgagaagctcgcgagctgcagattttgtcttgtagtatcgaagacgcgacagcgctatgagcagataggagagctgaacgcattgctgttgtgtcaaccattgaatgttgaatgtgcttccgtgtcctcccgtcagcttaatactaccatcaatgtaccagttgtcccagctcttgtccggcttgttggctgcctgttggttgaggtggcccaaaaacgcttccagagcgttggaggcctccttgacaggttgaaagtggtctcgttgaagtgtgatcatgagagtgaccatgagacgcaacattgtcacctggggaacatagaaagacaggttggcttgttgttcgacttgcctgagttgttgcaatacagccatgttgctctctgtgttgtgtctgttcagatcgagggctttgatgaagccgtagaggacgagaaacgacttgggtggtccgtccggcaggttttgccactgctgtgagatttcaaacgcctgttgggggctcgtgtccagtgtcaggtcgaactggtacatctgcagagtgtagtaggagtagttttcgtgcatgttgctgaacttttcgagacatttggtgcagtggtacaacgcggcctttctgttggtgctactgaggacgcgtacattgagacattccatctgcagaaccaggtcccacagtccgctttggctcgccattccaatgcccttgctgagtagcgactcaactcggtccagacatgccgtctcgcagtacagaacctgcgccagaatgtacattgtgtagcagcgtgtgatctgtggacagttacggtcgttgatgaccgtttcgagtgacgtgatgcccaccgtcagcaggtgtcggtattgttgcagttgttcggtcgttttgacctgcgacgccagcgacgaggcggtccacagaatctcgtgcgctgtgtagatcagcaggtcgcgtccctcatggctcagctcggctgccgcgttcatggtgcgagtgttgtgtagttgtaaagtggtgacatcgtgagatgcagggtgcataaactttactgtgttgggtttgagtatttagttgggataatagttgggatttgtttaggggacgatggaatggcctaccgtgaaatgtgcctcctcctcttccccggactgagatgtatactggttggaccgccagttgttaccggaattctgaattatcgtgtttttcgtgttcagaaaactccattttgcttgtattcgatacatataaattgacgttgatcgaaaagaaaaaaatatataaattataaaatatgtatatataaactataatatatataaactataatatatatatataaagtataaaatttatatataaagtataaaatatatataaaatataaaatatatacaaaatagaaataattataataaacatacggaatcatcacttgattcaactacgagttctttgatttagctactcgttccacgaaataataataatggagaagctgttggaaatactccagtgttgatttgacaatatatcgagcttcagcatcgaatactgtgtaaatattgtacccgtgtggaataaagatatttatttatgtaataaataacgacttaaaagtacacaacgtatcacttgctgaaggcgtctcgataaccagacccttctctctatcagagagactcattcggagagtctccgcatcctagggcagtagttaccgtagagacttgcacttaccggagatcacatcaactccaagtacacattggagattatgacatccacttgagggaactttgtggccgtctctgattacgtgatttaggaggtagctggaccttcaatactctagccatagaggtccgacatagcaacaccatgacgcagctactcgctgatagagaagcagggttgatagaagatgttatgaagagagaccgatacacacacaggtacactacctggccaattccccacagtcacgagagggaccgctgggtggtagagagatgtccatactgtagactactgatctaatctctttctggtgtgctgctatcggagcctgaagtccctagaagtgatcttcaatatcctctagagtactagagatgagatagtaatatcgcacggcacaggctcaaaaacctgtcgaaatcccgaggagatcaacaccgagcttggtctgatcttattggttgctataaagacgctgttgacaagaccggcgactacagcctggtagagaagagtacggacgacgagacaacgacagaacaccgtcaacaatcgaaaaggtcaacagaggatatacattatataaattacctctttcaagagcaattggaatcggaacggatggagttgaaaccacaaggaaagaaaaaaaaaagctgttttcgtgcttgaaatgttccctaatgaatgtagcaaatatgttcattctgcctttggctggtagatgtagggcttgattggtctcgctgaaacgttcaaatgggtattccagttgatatctgctactcgcgaagtacactatgtactaaaaatgtcgctacttgtacaagtatgacgaatcgcactcatctctgccagcacaaatgttggcggagttgtcgagggacgaagcatggacaaagtggctgatagtgtcgtaatgtcaaactggccaatccgcacaatccgatggactccttgaagtagagtatgtactgtacagtcgcgtacttgtactttttcagtcttgtccgctagtctggccatgttttggcttgaacgccttactcaagacattcaagagctactcgaaaatacattgatcagtctcgtacttgttctcatacttgcacatgtacttgcagttattctcgtactgtacgtgattgtacttggactcggactcggactcggactcgtgttgactggactcggactcgtattgactggaacttctactcatagttgcgccgtatccgatcctgaatctctcgatagcgagattacaatgtatggactcagccatacgtactggtaagtcgattaaattaatgattctatctatctatgacacagcttcatgcaaaataccactgtgaataaaaaggagcccgatggactgaatgaaggagccaatggactggaagaaggagattagttgggtctcacattgtacttgctcttggaccggattctcttgccgaaaatgtaaaagagaatggggacgggcaacatgagaacggcgatacctccaacaagagtgccggcccagttgacgccgagattgtggaacagagcgggggtaaagagaggaaaggcggctccaaaggacgatcgcatcatggtgttggcagccatggccgaggcggcaaacagagtgtagcaatcgacaatgtagttgatggaggcgaggaaaatggtgatgaatccgactccggtgagaagaccagaggcggtgggaaccatccaatggatatgttcgtgataatgaccggtccaagtgagccagaagagtcccagaggcagacagcagcctccaacaatcatgggaggaagtcgaccctcaggagtgcatccatttcgggtgtagacgggctcaaacgccatggagacgatgcaaccaatggcctcgccgataataagacccagataggtgagcatagccactccctgatgcattccgtagccctcggcaaagatgatgggatacactcccagagccatgtacatgattccgtagaggaaggcgacaaacagagtcaccaagaagagagtgggttcggtgaaaagcatcttgactggtcgcagaacgtttcggttgatgatctcgcccacatccagctctctttgatcgtgaagagaggtgattccccagtttccggtgattttccgcagcttcttggccttgttggcgagcaggaccggagcaaaggtctcctcgcagaaaaagagagtcaacacggtcacaagagcgcccagaataccggtcatgtactcgtcccatctccatcccgtgctggggttcttggcgatgaatccgccaaccatgggagccaaactgggggccacaaacacacacatggtgaaggcggccagggcatagcctcgctggttagcggggaacatgtctgagtaagaagcagccacaatggccagaggggaggctccgaagaaaccggagaagaaccgcgtcaacatgacggtctgaagatcctttgcggtggcagtggcaaaggtgaagagagtaaaaccaagcatgccgatcaaaatgggaggtcgtcggcccatcagctcactcataggagcccaaacaatgggaccagaggcaaatcccataatgaagagcgaaactccaagaagaagcacaacctgaccgaccttgaactcggcaatcaactgtggcatacccgccgagtataccgaagaacaccaggagacggcaaaggtgtcgagtgccagaatcactgccgaaatgcattttctcttcatggtccagttgagaggagacagtgggtctttgggaccgtcaaactgcacggtataatcttcaataggaggcagggccttggggtactgttttcctcctccaaaggggggtagaatgatatccgtgtcactatcgtcgggtgtctcgccgttaagaatcgatccagatgcaagttgagagaccaccgagcccattcggcgacgcatggtgtgtctggagggctcggacacggtgtaaagactctgggtatccacctgatcttcattcagtgcactgggaggtctaccagacatgccagacacctctcggtgaagccgaagaccgtcttcttcctgctgaatcacatccggatcatcggggttgtcgaccaacgcgtcagacacatatagagtctggacctggccgtgtgagtttcgtcggtagagatgctgagacgaaatggagtgagtagtggtcatagatcctgctcgggcatgatgagggggcttctcctgggcctcgccgtcggtgtcatcaatagccgattggtgtgtgtagtaggcctgaggctcgtactcttcttcggatgttcctgacgaatgggtcattttctttgcggaaccagcagtcggagggtgcaaagagatatatatgaggttgacaagcgatgcgaggttatgcagaatagagtttggctccggatcaattttgcgagcttggggacggttttaatggaaaaaagacaacggagatcaacgcgttaactgctagaaaaactcctggcaaactccgagctgttttggccgagtatttgtgcggtttctagacgacatgttgcggtcaataaccgagccgaaaaagtatattaaaaagttgcaaccttattttgcatcttgtcctgtggttgacgggccctgttggttgtaaatagacggggaaatggcatttttgggtatactagaccgtttgcttcatcacatgactatctttttcggctcttacgtctcctttaccgccctggtggtgctaaaagttccgcgccactactacacagccagaactctatggcagatgtgacatttcttttatgtgggaaccaaaacggccgaaagctcaaggtgcagttgcgaggattggcacaagcctcacggagccagggcgggacgtccaaactttgagacgacacgaaatccactttgcaattaggtctttggacagtctggttgtagtagaggtcaagttgttgtgaaatcaaccagagagcagttattcccggtgaaaaagacgctgcggagatggaaactgcacaggagtgtccaccagacctcggggtacaccgccaagggtttccatctacataaatccgagtaatgcgtcttgttggagctgccgaaggggcgttagggtttcgcagggcagtgagtagaacaagtgtcttcgtaagggtaatgaggatctgagcaagctgtaatttggacatgtgaattatacccattacaaggattctctagccagttttccagttgcaatctgctgttttgacccactaaacggcctgctattggagtcattaaagttggactaaatggtgcaaactttgagcaagtgcactgtatgtagtgtacgtagcaaagcaactgtggatgtgatgtgaatagcgcaaatgcatggagatgtttgagtccgtcagtgtgctttataatatcagtgtgtccctatgcgagtgatttactgtaaacgagtgcagatcagtgttcgcacagtacgagtatacaaagagcgcgctccaatatcaactgggacttcagcatttagaacacgccgtacggatccaggaacaagtgagcgtccatcttcgtagtctccatgtgattccaatacgttccggtaactacaccactatagaccgtatatctccaagggcgaacgaactgggagtactatactcgcacggtatcgtacagtatcgtacagtgtacagcactcgactcttactgtacgataggaacaccaccaacgcgtatccctgcgggggcaatacaatatccctctcttatctaaagttatccgtcgtgttgcagtcggtctctgaggttgtcggcttcgggatcggtgatttgagatgatccgaatccggtgtaaagatgactctggacctaaacatccagatcgaggactcttgttgtatactaaacagctgttgtggttagtgtccgctaaaccgtgcatttcaaacacctataccttcacatcgtgtaccgtgccagggctagtcgggcttcaaacggctttcaaggacagctcattaaacacgcaattttgatcggaattgaatttctcagcaccaatgtgaagcaggagtcttcacaatttgattggtgtcgtttaaaatccgagtcaccaaaaatattccttccaaaattggtacacacgcccctgatttcggaccccgaacagtcaaactcaaatttgacattcataacaggccgttttaatttttttgttttaatttttttgttttaatttttttgttttaatttttttgttttaattttttgttttaatttttttgttttaattttttgttcttttatttaattttattcgatagccgttgcatatggtaggtttatgcaccaaaaactcgtttatctatcgtcggaaaaaatcgccgaaatatagagaaaaacagaatagtaaagaaaaaataaactgaaaacccctgaaaaccccacaattcaccgctgatattccaaatagacgcccaccatcccgcacacaacccatccaggcagctgtccaagtacactacatattgtacataggtctccacccgattaggagccggagtcggtagaactcacgtaaacgaaatcgtggtgggctttgcacggcgctgatacaacaccatatcctacttgggtctccacatttcaactgtacatctcccggactcgttaaatcagctaagcgttgtttgaccaaaaaacctcggataattcttcacataccaccaaaaatcccccaaaaattccccaaaaagcccccaatgatctcaaaattactaaaaaaaagtaccattgtacaagtatctcagtaccgactgacccacaagctctcgatagacaatgaactccctcgtattcaatacacggcgttcatctgtacttcgtgtcgtctgcagacatgtgcatcttgcattcattaaaccgaatagaaaacatcataaaatgtctaaaaagggtctttaaaataccccatacgactttttcaacatcttacttccgatattcactcctcgatccccataaaacggattatatacctcattattcctcttcaaccgacttttaagaaatccactttcaatacccgaagtgcaaaccttactgcaaattctaataaaaaaccgttgttctcaaacggcctcttctggatgcatatttcatgtgaaaaaaaacttggcaggcacccagagaccgggaaaacccaaccccggcgtcggtcatgtgatcaaatatcaccgcggcagctttttccccgccccgagatctcgccgagatgtgctcagaaacccaaattttcctagtattccggcggatcagccgcttccgaaaacccaagtttatttttattttattttttaggccaaaacgatcagggttagggttaacatggaagtttgcggcggtttatttaattttaatagttgatgtgaaatgtgtggcgatatgggcagaagttgtccagtgcacacggggtcacgcgtttgagcggtgagtgagcgggggaagaagggctggtcacgtgattgaacagtggaagtggcgctggtcacggtttttcaacttctagttcagttgggttgttctttgttggagtttttgttgtagagttaagtaagatgttagtaatatgaacaccatacttggggttttactttgactgggtaccaacatcatggagagttgggtaaagtccaaatccgacggaaatatccgcagatacttgcgtacattgtgggcattgtttgacgaaatacaagtctgaactggtgtcaggtttagaactgacaaaataacaattctgaactgttgtcgggtttcgatcgtgagtaatgtcctggtgaactagttgtcttggttttgccatcatcagagatctgacagtattaccagtattttcgtcaattattagacgatcattcaggtacaacttcggtgatggtatgtactcgtagtataatcgtacaagagacaagtacagtacatactgtcgatgatatcctgatcgaagacatagagtgttgaagatgtcctggcacttaatactcgtagtagaagtctaccttgtgcttgtacaaggttggtgttgatcctagcacccctggtcgtcataccatcggaaatccatagtccacacctcccagatactcacacttgtaggtatctgtagttggctcggaagacacgtgaatcacgatacccggcgggactatcgaaggggtacatgtatttgtagtggatttgcataggttggcagtaatagcacctgacaatcggatgatgttcaagtgagattactggcccacgaccattctcgccagccgtggtggttcatcgcgtttgataccctgactaacccatgtatcctttacaggttccaagagtacatttaccagtctgggagttgatgattcgtcggagaggtttggggtcgtcaatccttctgaattgctagcgggtattgatgtttctggatagatttcgttcagcggattttatcatcgagtgaaaagatagataccatcaccaaccacgtcttcgtatattgagagtcgtgttaccaatgacgctcggtgtcccatcgatcccgctgagcagcacaccaatcgttgaacacactagtcatatccacagagcagctctgattacgcgtgcttcccgtcatgtgagatatccccagcccctggtcgagacacgcacacaccatggaatccagtgtacaagcccacgggtctctccttttacccggcagcatatggtattgctatttggggggccgcctgcttgtattgcaggatttcgatggccagaaaagtctttccggtgagcagttcacccacaacgcacccacaattccatgtagggcaacaaaccgattcagaacaccgtcattgcggccacgaacagtggcccaattgaggttgtcgtactgcgagtggttcatggtgccgatggcagctagatttttgtcccacaccctcagagcacgccatctcgtcctccggtcctgcttccagtcctcgtcgtctcccagacagttgtcgagcggtattctatagcccaaatcgacccgcagttgcagaaaccggccgtgaatgaaaaagtacacgtactcaatgcgacggaattgtacacaaaatacgtctcaagagctcggcgttcggctcaatacatgccaggtaagatgttggcgggtcctctggtttgtactccattaccacagcccgggacacacgagaatggcgccatcaggggccttggtatgcggtgccttgtgcagcatcttgtccaccacctggtgcaaaacggtccagcgcgcctagatcaggtggtcgtttgtcgtccaccagctggacccaaccatcgacgtgtgcgtgccagacctttgttcctcgcttggtgatgatctctctctctgaacaatgttctcagatccacattcgtatgcatacccaccagatgtgttcgctccaactggttcgctccaactggttcgctccagctggttcgctccagctggttcgcttcagctggtagtcttcaaggacccccgtgtccagcttttcttcaaacagcgccttcatcccacgccgcacactggaatctttggcaatatcccatgtggcaatcgcgtccacgtcgttgcgacacctagacatggcggcactgaggtccttgatgagcagcaggttgtcgtggtcatggctcagggtctttcgcgacctcctcaccagccggaccacgagccttccagcgtcttgaaaacctcgaggcacagcttgtgttgtctccgacagagccacgactgtgtccagattgcactcccggaataccaagcggaagacgtcttctttgagcgttttggcgaacaactaaagaagaaatcgccacatactacaacaacatactgaactgtgctgtgctgtgaaagttccgtatcaacatacaccgtcccggatcaacatattttcgtctaaaatcgggagacttggaaaacagtcgaatgggggactaagcggatccggttctttgaaattggtggaaactacaagataaaaaagtcagatggcggacaaaaatatggcgacatccgcaggattcgaacctacgcggggaaaccccaagagatttctaatctctcgccttaaccgctcggccaggatgcctacaactgaaataaatacagtgttgaaacgttggtagatgaattatgatattttttaacatgaaaaaaaaaaaaaccccggcttactaggtatatagctgtaatgaatcattagaataataaaaaaaacatgaatcattaaaataaaaaatataaaaaaaatgaatcattggtataaaaaaattcgccaatttcaacccccaaacatggaatagagcttctgaaagtatcttgtcatctttctggggcagcaaaaccgtctgaatcaatttcgaagctcgtgattgtcgatctcctgattgtcgatctgcgtgtttgagatccttcaggttggtgattgtatgtggagatgtggagaacgatatataaaggtataacgagtacgtagcgaatacgagtaaaatgtacaagtagttgatttacaatgtacaagtggttgtgttacgatgtaagaatagttgtgtctacttctttgacaatccccattcagtccaagtcttgtacaagtactaccgcaggagaagtcacttccagacctctcaacgggcagatgaccatcgttaggccagcggtacaaagaactgaatcaagtggcatatgctcacttagtaacaccatggctgttttcaattcagttgtgaagaatcgtggccgaaggatctggtgcctgtgacactttcaaacgcgatgcacatcagattggatcaagaagccagccattggaagatcaccacctcccttgaaatgacctaagaaagccattgagtcccattcaatctgctagtactcatgattgcttttctgataccttcaaactcctacctacaatcccacttcaatacataatacatataattacaaaccaacgcagccagctccttatgcttactcgtcgtcatctccaaacagatcgtccatgtcgtcgtcaccatctgcatctccatctgcatctcctccgttggcctcggcctcctcctcaccctcaggcttgtcctcaagctgcgacttcttcatcaatcttcgcttcttgggtgctcctccctccttcttggacttgcgcttgctgggcacagagtcgccgtcatcactatccgacacgtcgtccatgggaacattgtcgtcgtcctccacaaactcgtccagggccttcttggacttcttggacgtcttttccaccttttcgtcggcctcgttgaactcccgcattcgctcggcccactccagcgcctgctgctgctgctgctttcgctcctcctcgagcttggcggccttctcggcggcggcctgttcggcagctgccttttcggcggcagccttctcctcccgctgcaggacatattgccgggcctcctcgagcttggcgttgttggcctcgtcgtactccttctgttccgccagtgcacgctccagctgcttcactacagtgttacccattgacgctcgctgctccagctcctccttggggaaaggaggcgtgtcggaggaagccagctccttgagcgacgcaatggcctcggtcattcccttgatcgcagcctcgatttcgctcagctgtcgtttgctggcctcggtctttcgcagcacctctgccacctggaattggatgaaggccacgttgaaggtcgtgctgggatcggcctgcagctccacggcctttcgacagagctccaatgccgtatccaggtacttgagctgcttggcagagatgcctcgggcgtaccaggctcgtcccaaaagagacaacagagtcacgtctgagccgcccttgaagcggtccaaggcaacctcgtaagactggatcgccttgtcatattgcttgagatcgaaaaaacagtgacccagattgacaaacacggaaatgtcgtcggtgatggtttctctcacacgcttgaaaatgttgatggccaggtccgctcggttggtctcagcaaaaataactgcaacaccctgggcagcataagcgcacttgggatcaagagccaacgccttgctgaagaactcggctgccttgaagtagtttttgtttttcttctccacgtctgagttgtttttaggcttgatgcttcgtgctttggtaaggtaccagttgccaaacgacactagagcgtagacatcatgcttgtcaaagtccgtcagggtcttgatgagatgcgtctcttcggcctttcgagttcgacgcagataccagccctgcagagctcgtacctcgaggttggtcaccatgcgctccatcagagcgtccagccgaccaccgtcgttgctctcaacaatgtccaaaaatgccagtcgaatatcagcgtcggggtactgcatggactcgtaaatcttgcgggcctcctccgtcttgcccttggcctccagagttcgaccaatgttgtaagtgatggtcacgctctggtcttcgtcagccacctccttggccttttcaaacgaggcctgggcggcatcgtagtcgtgagcggagtactggtaaatagcaatgttgttgagagtggcgggatcgtcctcgctgctcactcgcttgaggtgctcaacagcagccttggggttgctctccagcttgctcagcaggagaaagatctcctcgtccacggctccgtctccctttgaagccacccagtgctgcagcaatggcagcgccttgggtgactcctgctcggcgtagatgagcccgagcataaccttggcctccagacacttggggttggagttgagaatgccgtccagcaacagtgtggcctcctgaacgttggaacgccacagcaccagcgcacggccaagcttgtaaccgacattgtcccggtcaaatttttcggcctgacggaagctctcaagagcctgctgcacatggccggccagctgatgagcccggcccatccagaagtgaatttgacccagcaccttggggttttcagactggttgatggcagtgtctcccagcttgacgatggcgtctgtgtttcgcttggtgaagaagaatttttgcagctgcaccaacgtgggcgcgtgcttagggtcaagttcaaatgagtccttgacgtgcagcatgcccagcgcgtagtacttttcaaagtcgtcggtggccacgttctgcagcgccttgtcgaacagacaggtggctagcatcaccttgacaaaggcgttcttgtctttagccaactcattggcccgctcaaacgcagcaagagcctcctccttggagcccaggctccagaaacagagtccaatgccgattcgcggatcgggcttcatcgaggggcgctgactcagcacggactggtacagtttgagcgcctcgcggtagtttttcttctcgtatagcacacgggctttacccatgagcgccagcaggtttgtgttttgggtctggagcacggtgttgaagttggtgagagcgccatcccagccgccggtctggatcttgaacacggcctcggtcagcacattgactcgccacgttttgtcgatggagaaggccttgttggcgtactcggtggccttttccagcacggccgatcgttgatccacaggggcagcccggtactgcttgagaaacagccacaccaggcagttgtacagaggcagccgatctcccgactccttcattgacggcgacttgagagcccgcgtcaccacctcgatcgcctcgttggtcaggcccttggacgagtatgccagaccaatggcgagccagaaggccttgtcacatcgctcgttttccagcagcacgcagatctcctcggggtcctcttggatatctttgtcgaggtccagcgagatgaagtcgccatctgcgtccgcacacgggatttcgatgatgttttccgacatgatggtgtagtcgtgttgatgcacctgtcgtcagcgtcggggttttggttttgtcgattttaggttgggaatatttccgtttaatgtggccccctggggaatcgaacgccggatcatatgcggctcgtgcatatgcaaagaaataaatattgagaagcatatccctttttatgaccgacatttttcgcccgtcacacaatgagactccacatttcgaatctcaacccgtcgctgaaggaagactcgtctgacctggtcaagcgactcaacagattcgggtcgaccacgtctgagcttgaagtccggcagaaacccacgatggaaaccgcctacgggttcatcgacattgatctcgaggacaagcagcttgggcagctcaaaaaggccctcaacaacgtgcggtacaagggcaacgtgattggcatttcgcaggcaaagcccaactttatggcccggtggaaggacgacaagaaccgccgatgcagacaagaccatgatgccacgcgacatgcaaagaaacgggagattaacatcatccccggtagaatccgaaagacggctcgaagcgcacaaaagctgcggggccagtggtgccgcatgatcaaggacggtaaggtcgtgcccgtcaaatgcaagcagtccaagctgtggggataccagcgagacaagcctctggatcagctgacatacacttaccgaaatggccagtggtggagtggaaacgacgatctcattgagacggtcaagttccaggccgacgagccgggtctgtttgaggaggaggaagaagagaagggcgaggagaaggacatgcacacccggctgctggagtcgctgttgtctggaggcggggactttattgtctccgacgacgacattcctcaggctgaggagcgtgtgtccgctgcattcaccgggggaaactacgacgagcccgaatatgtcaagacagatccgtacgtgaagaaggaccctatttttgatgagcctcccatggaccgagacaaacgtcgaaccgacatgtccagtgacgacgactcttctgactccagtgatgaggagagcgacgacgacgaggacaagaagcagggtggaaaggatcatggaaaggatcatggcaagggtaatggcaagggagcttccaagtccggaagtggtgagaagggtaaggagaatgatgatgacggctctgatgattctgatgacggttctgatggtgattctgatgatgaatcggattctgatgatgactcggattctgatgatgattctgatgattctgatgatgattctgatgattctgataatgattctgatgatgatgactccgacgacaaaatggatgccgaggaggagactgacccgcccattctgcaattcgaaaacacagccgataccggaaccctgcgaaacctgttcaaccccgaaaaagagtccaagttcacactatttggaggcgacgacgacaacgacgagatggaggtcgatgaagagcaggttgaagaggacgacaaaccccagcaagagacggagtccacagcccccagagccaccgcctcaaccggactgtttttcccccactcagactcccctttcctgtcgacacagtcccagattgcccagctcaacaagaagcccattgacagcgacaattgggaggccgagttctgggaggagcgaggcgatatcaaggacgacgcacgatcgcgaaagcgcgacttccagcgaaagaccaacaaggacatcagaaagtaggataccgtttgtaatataggataatgcattgtttaacataaacaaaaaatgtgcgaagaaaatgatcgtgaatcacacgtacaattgaaatatataaaatcgcttttatattgatgatttaaaaattcaaaaaataagtgccttcgaccagatttgaactgatgatctcagcattactagtgctgcgccttaccacttggccacgaaggcggcttttttaaattctagattctgaatcacgggcccagaaatacgctgactaatctggtaaagaaggaaaaactcgaaaaaattggtgccattgagcttgaggttgaattcatgtgttataatgcatcataaattagagtaacagctgttcattttgttaggtgaatggtcaaagacgggttcttcacgttcgtggagggatacgagaaggtctccagttgtagtaagctgggaagtgtggagtgatagtaactgaatttgttttctgaatgctcagatccagttagtgcctctttcaacaagtgttgattctccttcaacctgctggagaacaatgtccagtctaatcagtcccggaatgtgattgtagacatggccggaagaagtaatgaccttgattctttctgttgatcttctgtgtatccgcagagctctttgggaagcaggtatgcgttgaagaagccagctacagtgtgtactgtactgggggtgagcagaacacagagtttggagtcgtgttggaagtagtgattacatacaatatgtacatagtgatatctagtccagttttggtgactagaaagcgatgactcgtgaagatgtcaggtcgcttcattggtcctgaattcgagggtttttaaaactcgctattcccatatactcactgccagtctaccgacggcaatgccaatctgacggtgtttggttgaattggacagactctggaattggagagactgggtgttgacaggctctgaaatttgtcagaatagctccgttaatgtctgacaaccgattgactgtctccgatgaactactcgcacatcatttgcaaggttgttcccgactgctctccagtcggagagattcccaaacgattgtcccattcttgcagaaggtggatcgggcgtaaccacaggccaggactcccatatcattagggggatttaccgtctccggaacaagtcttccccgttcagcatatccagatagccacttgtctataaggcgcatcaccagtcaagtctacttgtacttgtagaacatgggctttttgttccgcggagttctcgttcccaagaaattaatcccaaagtagacaccaacatttcatcacacaaaatggcagtttttggctgaaatatcccctaacgacgtcagtaaatgtgtttctacagacccggttcagtatcgtcatctaaagtttcatataatgcaaacctcgcataaccgagaactttgaatatggcaatttttgatgagacaggtgaaacacacgaagaaacaccatctctacaagagaaatgattgaaatcgtacgtacatgtacccctcggtgatttgggtgtcagctggcggtccagggctcttctggagtgacttgagtgcttgtacaagtcgtcgcttaatgatgaaacagagagtcgtgatctgtgcagttctctactctactgaaagagcagatcttcttcatcttttctcctgtgccaattgttcaatatactcatttctattgattactaaacccatttccatgattctgactagtctacctcgatgaacagaaccaccattcctcgaggttgcagtctgacggtggcaaaacacaatccagtatgtaataatatgtaaagctcatcatgtacaatatctgttattgtactactaaaactgactaaaacacatgtgcagcaaagtaccgggtcttctgcaggtaggtcctccctgccgctgttagacggcacagtgttggactgttgctgatcgatgttctcgtcgtgaacagatcagatcgaatcagaacatcttggatcaattgcagcttcaattgatggtcgtcaatgtatatcgttcatttattcgtagctgatcagttcaacaggtcgacatagcaggtacagtgtagtgtacgatgtgcttctcaaaggggagtacctgtagaacagtacagtagtgtggcgccaattattcgcatcccagtcgatactacttgcagtcactttgggtgttctatgctacacacggaacatgcagtacttattcagcgtgtttacacgttgtatctggaagtcctgttctcatcatcatcatttggagggaaatctttcacagagtccccaagcgtgcaaaggtacgagaagtaccatacaaaactgagaaaaactgatctaaaaggccactaaaaaagacaccaacttttagagaacgtgacggcacttactggtcggtatggggatgagctgttcgaacaataagtgaccattgatgttcccccaaggagttctaaatcgatatcctgacctcccaagcaacggcataatggcctttagaaagtacactggtcttgaaagcatgggattgtcgacattaaagtggttattaagttcctcttcggtgtccgatcatgtggagaattcataacacacggcggaaaccatagatagtgacttttacagaagactagccagtgtagtatctgtgtgggggacctaaggggttaagagcaataactccccattccatgagctctccatgaacagttcttttcgccatcatccctaacattgcccctgtcgagcccccatcacccccaaatcatggatgatatacttctggacgccctcgacgatatccagcacattctggaggaagccgggccagatacaaagaactttttggaaccaattctaccctacacgcccattttgtttgctagtcacgacatgtccgtcgagaaccacgaaaacattgccctttcgccccgagtgatgaacatttgtcgagagtttcaaaactacgtcgagggtcacgagtatgagaaggctggcattctagagctcaagctgcggctttggacacttcatttgtctgtgttggactatgctcctccattggaacttcctctggttcgagagggcgacgatgaggtccagttcactcgcatgctcaatgaaatgttgcagatttgattagtgaaaaacagcgtaatttatttgtttgaaatattacagtactgtatgcgcgtatgtacagaatctgtagttggatcagtgcttgatgatccggttgtacttccagaagagagtcaacatgcccatatcgtgggcggcctcgagaagaccggtgatgaggaaagcaaagcccagcatgttcttttcggcaaacatgccggtgaaaatgggacccacagatcgagccagcgtcttgaccacgttgacgatgcccatgaccttggttcgctcctcggcagacaccacgtgcgacaagaaggcctgtcgcggtaccacgtccatgacggctgtggacgctcggaacagcagcagagccatggcaatgggcatgtttggagccagtggaatgaaggacatggccatggctgaggggaagtgtgcagcgacaatggcaatgatggggcccagacgcttgtacatggacgaagaggccagcgacgacagggcgttgagcacgttggtgaagaagaacagagtgcccacggtgctttcactggccttccatcggtccagaaagtaggtgacgacccaggagattggcatgaagccatagcccatggagtccagagcaaacagaatgcacagcttccacaccacctgtcgacttctacggctgagaggagtgccccagactgagaacttgggggactgggacggagtggggtcgtggtggtcggtgggacgcaacaaaggatcagactcgtcaccagtggcaatggcctcgtcccgtcgctcctcctcctccgatcgttttcgcagctcgcacttgtcgcttagaccccaattgagcagcagcttgaggaacgcaaaaaaggcatattgggcaaacatgaaccggtagaccttgagcttggtccagccataatggtcaaccagcccatcgatcatgagtcccgcagacacacttcccaccgcactgccaacagtgccaaacagcccgtaccacgcgtaaatgtccgacaactccttggtaggagtcaaatgagcaactacagactcctcaatggacttgaagggcccggtctcgtcgcccgacggactaatcacgccaacaattgcggctatcaacagtacaacaaagtgatcggaaaagacaaaaacaatcccactgaccatcatcaggaaagatcccagcaacagcacatgtcggcgcccaatctggtcggcgtaaagcgtcaaaaagtagctaataattacgtccccgagcaacgtcagcgtcataaagtaccccagactaacatccgacacgtgaatcgcccggaaaaactgcaccagaatcaaagtgctctgaccataggcaatcattcgcaacaccttttgcgcaatcagaatcttgatgtcacgtgacgaatgcaccagcgaactccacccaatctccttcgtgaaccgcttgaacgcgggctccggcaattcaggacctcgagacattgatattggcagtgtattgtattgtattgttggagaggaaggttgctgccaaccgggttgcttttatatatgcggaatccgaaccttgatttcgggcggttatttgggcggctatttaggtccaattaattgtcttaactaattctactagaaatcaagtaattaattatacattgtacaaaattgataaaaaaaataagaaatactacaatacattcaatcaatacatgtaattggccattttgtctagatgagaagagccatcagcggaaacagtgaagctagagtcgtggccttgagagtaacagccaggttggcctgttctgggccagatccaggagtttcagggacagactgctcggggacgggttgctcgcctggctgactaggagtggaagtctcaggagaagagggatgctggggatgaggagaggaattctcgggagaaggagagggctgttcgggctcgggaacctcaggtgtgggtttctcgggcgtaggcttctcgggcgtaggcttctcactctggggaacctcaggagtaggcttctcgggcgtaggcttctcaacctcaggagtaggcttctcaggaacctcaggagtaggcttctcgggcgtaggcttctcaacctcaggagtaggcttctcaggaacctcaggagtaggcttctcgggcgtaggcttctcaacctcaggagtaggcttctcaggaacctcgggagtaggcttctcgggcgtaggcttctcaggaacctcaggagtaggcttctcgggcgtaggcttctcaacctcaggagtaggcttctcaggaacctcgggagtaggcttctcaggaacctcgggagtaggcttctcgggcgtaggcttctcaacctcaggagtaggcttctcaacctcaggagtaggcttctcaacctcaggagtgggcttgatctcctcgacaggcacagaatggacaactgtcttggttaccactgtagtggtctcataacactcctcgttatcacatattgaagtggtctcagtaaggatctcggtgacagtggtggggacagaaggcacctcgacgggctcggtgatggagggggtctcttcgggatcacaaggaacagtcagagtcacggtcttgttttcgatagtggtgacaatggtggtggaagagtgcagggaaggaacttctgtagtaatagtcacggggatggtagtgcactcgtcttcacaaacagttacggtggtcacaactgtagtggtgatgcagtcggtggtggtaacgggttcaggtgtagggcagttatcgattgtggtggtcacagtggaaggctcgccagcaggatcagtggtggtgacagttgtggttgtgacacagtcggtagggaccacaggagtgctcacaggagggcagtaatctgttgtgaccgtcagtgtggtgggctcaccattgggaggggttgaaaccacggtcgtgatacactctgtgggggacactggctccgaagtcactggctcaggagtacaaacgtcagtggtaatcgtcagggtagtagggtcgcctcctgggggagtagaaaccactgtagttgtgcactccgtaacgggggcactggttgtctgagtagggggctcggtagtgcaaatgtcagtcgtaatcgtcagggtagtaggctcttcacctggaggagtcgagaccacggttgtaatgcactctgtaggagtcactggttcggaggtcactggttcggaggtcactggttcggaggtcactggttcggaggtcactggctcggaggtcactggctcggaggtcactggctcggaggtcactggctcggaggtcactggctcggaggtcactggctcggaggtcactggctcggaggtcactggttcgggagtgcaaacgtcagtggtaacggtcatggtggtaggatcaccacctggaggtgtagaaaccactgtagtggtgcactcggtaactggagcactggttatctctgtagttggctcgggagtgcaaacgtcggtcgtaaccgtcagggtagtaggcacttcacctggaggatttgagacaatggtcgtcacacactctgtgatgggaacggacgacgagcacacgtctgtagtgatggtgaaagtgctgggctcgccggtgatgggagtagaaacaatagtggtggtctccaagcaaggatctgtggtggtagatccggaagtttgtggctgaggagtaggatcactggaacaggtgtcaacagttgttgtgtaggttgtaggttcttcccctgggggtgtggtcacgatggtggtgacagtggtgcaagggtctgtaacaggacttgaagatgtcggctcctcattagtggtaggagcagaagtttcaggggatgtagttggttgctcagacgtcgtgggctgctcagacgtctcatgggatgtagtaggctcttccgatgtagtgggctcctccgatgtagccgtgggctgctcagaggtcgtgggctgctcagaggtcgtgggctgctcagaggtctcaggggatgtagtaggctcttccgatgtagtgggcccctccgatgtagtcgtgggctcctccgatgtagtgggctcctccgaagtagtgggatcctccgaagtggtgggctgctcagaggtcgtgggctgcttagaggtctcaggggatgtagtgggctcctccgaagtaatgggcttctccgaagtagtgggctcctccgaagtgctgggctcctctgagattggtggagaagtctctggactagtggtggactcggtggaagttgcaggctcggtggactcaggaatggtggcaggatcggtggttgtgatggggacactgacaggtgtagataagcactccatcaccacgacttcagtggtccaaatagaaaaccccgactccgtttccgtggtctttgtgacccaagtctggaactcggggggacaggtggtagaaggggggaggaacttgcagtgtgagtagacaaagttgttgacgatgcatctatcatcttcatactcaataagggttcgggtactggtgacgtagtcggagggctcacaggtcagtgtagccgtgaccgtgtgcatgctagtgatagttgtagttgcatacgtgttggtggtctgctgggcaatcacaggagctgcgaaggccaccaaggcggcagatgagagtttcatgttggtgtgactttcaagcgaagaaacgggtctctttaaataatcggatttttgctctcaagaccccattctgtcttattattagtcgaaacgtgtctgccacaaacctgtgggtcccgggtccttgtggttgagatgcgttgtggtcgaggtgccgtgcttgcattgtgtgcttgtgggcgacaatgtgtgcttgcattgtggacggcattgtgttcttgcattgtggacggcattgttgaacgcattgtggtgtcagtgaggttgtcgtgaatggatatctgattcgtggcgatgtttcactgcgattctatagttgaagatcagtcgaaaacaccgacattgtgtgacgaatatataagcgctttttggagcatctcatcgactggttctcttagtcagcaaagctgtccatttggtcgactgcgcccattgctctgatgccatttgcttttgtttttggtggttcatcgcgagtgtgagataacaaagacggtgatctgatattgagctggcccgaacagtctaatatttaggttgcattgtgcgagtttaaattgagacaaaaagtagcgaaaataatcggggcaatgttggcactgttattttcagacagagcgaaatggagttgaaaggggctgaagaggagcccaaagggagccgaattagcagatatattctcacgtgattggatgccaattgtacctgaagacggcctgtccatctcgtttaggtttctgacccccccgattaggacaggtcaatagatgaccatcttgcagctgacatgcatgggtcatctaagagataaaggaaacagggaaaaaaggaaaaagggaaaaaaaggaaaaagggaaaaaaaggggaaaaagaggaaaaagaggaaaaagggaaaaaagaggaaaaagggaaccaaattggttgtcagtagatttctctagatacttggaagctatccagacgccagggagctgcggagggacaaaacaagtgaattaatagtcacacttgccagagatcgtgcgtttcagttatttcgaccaactatctaatacctattaccgtcgctcggatgttggctacgttctcgattaacagaaacaacggtggaaaagccaatctgaaacttgcagctttccctgcaacacaaatagcacgaaccctggtccgatccatttgctcatcggtctgtcgatctctgatagatcttccaagtgctctggatggcagcttggccgaatttttggtcgattgtcggttggagaattccaaggttgatcattccgagtaacagcgattcataaagactcccagaaggctccattacctcaccccgcgccctccaggattcagcctcatgcacgctttccattgtggaagtgtttagcggtggtagatctggagcaagcagcggccataacgggccataacaagctgattccgacgacttggtgggcgactaggccgacgacttgtggcactggttggtaaactgacccgatctatgctcaaaacaacagattgtctgccattttcggaacctatagccctcgtaaatggactattgaagaggtaggatgcgaacctttgcataattatgtcgtggagctctccccattcatttagacaatgactagcttagcaatctcgacactggtcttttggatgcgggcaaacacaccaaagtccagcacttgagaggaacaatggtcagccttcttggtggtattctgcccttcttctctctcttagcagcaatctcaggagccagagcgtggacttttcaactctttgataaggcaatacatggagaacagtgtagtaaagacggggtttcaaaaatgagctttgccgcttcacttgccattactgagacagtcgctgttggtttcttttttcttttcctccgcttgttgatacggacattcctaaacgactggcctttctcgatgaactacccagaaatataaatgtcatctcttcaacgacagatcctgagacaaccccacacccacagcgtcggaaatctgtatcagatttgttctgcgtcttcacggcgacttgaagcaaaaagaatggtccctagcaggatcgaactgctgatcttcgcgttgcaaagctgctatttcttattagcacgacgccttaaccaactgggccaagggaccgggatggttttccgagattgtctttgcgaacttgacatgaataatggtcctatcatggcgtgattttaccttgcttgtggtttaaaacgacttgtatgcccatttgatggtgctttacatgttgttcctagactgtgcttgaatatgatcgatatagaagtacgagtacagtatgtgcttgaacatcgggctctacaagtacgcgaacgagtgcaagcataggaaaccaatgttacagacaaaacttgtgcaatgtacgagtacagtatgtacagtacttgcagtttctttcttagtcgtagtgtaagtcgctgttgctgtactgttcgtactcgtacttgtctcgtcccttcaccacttctgccggcaggaggcacggcaaagagagcatataagttccaggtatgagtgcaaatctcttccaatatcacggtggccttcgaatcacagaagcagactgatctgaagagcgaattccttgttttttgtcgaccattcccttcttaaagggtcaagaagacagcatagtttaccaacagcagtttctgaacatcaactgtttctgaccaacagtttcgggtcggtactactgtacatcactagggtgactatcctcatagtcgctatagaacccagaatagaagtgtacattggaatattcttggttaaacacgttgtttttgttattctgaatacatttcagctatcagaggcccataaacaaaggtatatccgcacatcaaatgcgacgtattagtcattcgaatcaacagtggcatctctatggaacaaccttttccatattccaggtcctatggcacagcggtagcgcgtgagattgcaaatcttaaggtcccgagttcgaatctcggtgggacctcttttttgctcagctaatttttttggcaaatcaccaaaccaatcatttcgcgactgtcctcgaatggtatcactgaaaccgacacggtccacatttcctcctaaaaaagaccagtggaacgacgctaatatttatatatttttatatctatgtcaaccttaatttatcgcgttcacgacatttctccaacgcagtctaactaagaaaaacactctcgaattttccgtcaaaccgtttgccaaacacaatcacacaatgacgacattacccacgttgccgccgcttcctgaggacattgtcacggggatggaggagctgaaaatcgtcatgagcgcggctctggagcgccaacgatcgcagctggtgcagtctcggcaggacgtgaaccgggttctcaaggagctagaggaggagtccaagggcgtgtctctggagattgaaagccacatggctcgccagcacgacttgcggctccagatctccgagctggacaagcagatcgaggacagcaagggcacgattgtggaatacagccgtcgacggtctgagctggaaagcaaggtggaggctgctcagagggcgtgtgacgaggggcgacagcggctggaagagcagcagtcgttacggaggcgccaggtacagcacgtgatggagcagagcgtgcgcaacgtgcccgagctcatgtacatggaggatcttctgggaatgaagattgaggcggtccaggacgaccagctgcggtttgtgtttgtcaagctggatcccaacgactacgcccgcgagtttgcgtttgtgctcgacatggccgacgtcaactaccgcgtggagcagctggagcctactctggatttgtccgtggtggatagagttgttggcaagctcaactcctcgcgcaactttccgcagtttctcaaggagatccgtcaggctttcaaggacgccattatggagtaatcacgcttgcaacctatgggcagctcggcgttggtgggttggggagttccagaagattccacacagtacgttcggcgttcggggtccgaatcaccccttccaggtgtatgggacatgtccgcactgcctgaaaccagcagagttaatgtgttgcagtcgcatgatgttgtttcgggtttttaccggtacagtacgcagtaccattacaaaatgtttccactcgggatggcattcagttgctgtcgaagctggacgtgcaggcgagttctcaatcagcattcaatcatcaccgcaatgaactggaggtacatgggagtcggagatcattcgtccccttcccacccttccgcctctggcccctttcacttctggtccttccactggtctttccacctctggtccttccactctcgcacatgtaaacacgactacaatatttattatcgttaagctcagattggaagatagagaaagatagcaacggcaaagttgaaagaagacagctccgaggaggaagggaggcaagcccaacgttgtctgacactcaaagcggacaaggctctgacgctgtcagagcgcgagctgtcacctaagacccgctgcagtcgacgcactagttgacaagatgagctaggtgagcaccaaaggccgctggagaggcccaggagcacctgaagaagtgcatcctgcaccgtctgttgctatgacgtcagaagttatctctgcactgggtgtggacagaaatgtgcgccatttttcacgttgcgacaaaagtcttcgtcactctttcggtttacacctgcgtcccagatgcggatgacgtcaggatctctgagagccggacatgcctaccgagaatggtagacttccataggggtcgattttcgcgccggatcccttttttatcagtatatatagggcctcgtttcgctgtccttctctcctcattattgcaatcacaaccacaacaagacacacttcacaatgacttccatcgactttaccatgaacaacggcaagaccatccctgccatcggtctgggaacttggaagtccaccaccgaggaggttgccggcgccgtcgagtgtgctctcaccgagggaggttaccgacacattgacaccgcattcaactaccgaaacgaggacgctgttggtctcggtatcaagcgagccatggagaagggcgtcaagcgagaggacatctttgtcaccaccaagatctgggtcacctatcacgaccgagtcgaggagaacctgaacatgtctctggagcgactgggtcttgactacgtcgacatgctgctgatccactggcccgttcccctcaaccccaacggtaacgaccccgtctaccctctgcgacccgacggatctcgagacattgacgagtccggctcccagcccaagacctggaagcagatggaggctgttctgaagactggcaagaccaagtctatcggtgtctccaacttctccatcccctacctgcaggagctgctcaaggaggccactgttgtgcccgccgtcaaccaggtcgagctgcaccctctgctgccccagctggagctcatggagttctgcaagaagaacaacatcatcatgaccgccttctctcctttcggatctgtcggaggccctctgctcaagaacgagctggttctcaagctcgccgacaagtacgagacctctcccggcggcattctcacctcctaccacattggcaacggcactgttgtcattcccaagtccgtcaccaactctcgaatcatcgagaacggtaagtctgccgtcaacctgtccaaggaggacctgcaggctctcaacgatctgcacaagaccgagggtatccaccgaacctccaagcccaagtggggagttgatctcggtttccccgactttgacttttgctaaaaggtcaagccatatttatagacatagacatagaatacaagtactttgattacaggatgagagtgtgtatgattatgagagtacgagtatgagagtacgagtacgagtatgagagtacgagaacaaccgagcgagtgagtacgatgatcaagtaactcatcacctgtacagctattggttatcgaggtccaaagaagaaaaaaaagacatttaggtgaaaaaagaaatgcccggtaccagggtcgaactggtgatcttcagattatgagactaacgctctaaccaactgagccaaccaggcgaatctgccaaaaagtaaaaataataacactaagatcctaattttaactttttttcgcggacttgagcaatcgacccacaccacgctcacaatatctctcctcgtgttccaaagcctcctctgtcgatattgcgcctttccgaaactgcggtgcgatgattgggtgcgtctggtctggatgccaaactttaagccagtatctgcaaaagttggtaactgactcattttgcagtgcgcctaaacgcttctaaacttaacggttggttactacaaaaaagcgctagactgtgtcaaaatctcttcaccttttgatccgactatcgacccaactacaaaatgttccccctgctgccccaagtgagcagcgtgactgttccggctgtggctgtggcgcccggcaaggtgctggtgtccattctccagtccgacgtccccgagatcgccaaggagctcaaaaaggcgtttggacaggcccaatttcacatcatggccgacacagacctgtcgaccgacgagtacatccacctgctggacgccggcgcctcgtctgtgtttgtgtctggagagtccgctgttgatctggctgcctccggcgtgcctgctggccgtctgacagtgattggctccaagcccgacaacctggacgtcggcggcgtcttcctcaaggacacccccgctctggaggatgtggcgacgctggcctcgaccttcgccaagcagctgctgccctcgggaggagccccggttgtgtacgtcaacgtggaggatcccaaggccgcggctgatctggctgcaaccggcgccactgtggtggtgagctccgctaagctgaccaccgaacaccaggccgacaagctggacgacaagttccccattgccgatctgctgttggcgtctctgtccaccgaccgacaggacggcctgtacactactctggtgaccgatgtgctcaaccagtcgctcggcctcgtctactcgtcggctgagtccatcaaggaggccattcgaaccggcactggtgtttatcagtcccgacgacacggtctgtggtacaagggtaaggagtctggaaacacccagaagctgatccgaattgagactgactgcgatggagactgtctcaagttcatcgttgagcagaccggcgcgggcttctgccacttcaacaccgagagctgtttctccgctgcccagggcatttcttgtctggagaagacccttcagcagcggctgcaaaatgcccccgcaggttcgtacacaaagcgactttttgacgactcggatctgctgcgagccaagatcatggaggaggctgaggagctcgtggaggccaaggacgccgaggaggtgtcttgggaggctgccgacctcatctactttgccatggtcaaggttgtcaaggaaggcgtgagctgggcccaggtgatgaacaacctcgacagcaagcatatgaagatttcgcgacgaaagggcgacgccaagcaaaagtgggtcgacgctctgggcatcaagcgacagaaggtggacgagaagcccaaggaggagaagaaggaagagaagaaggaggagatcaaggaggacggaaagatccagctcaaccacatcaatgctgataccgcctccaaggccgagattgagactgttctggcccgacctgctcagaagacctctgatatcatgaagcttgtgcttcccattgttgagggagtcaagactggaggcgacaagaagctgctggagctgaccgagaagtttgacggtgtcaagctcgagtctcctattctcactgctcctttctccgaggacctgatgaagatttccgatgatgttaaggcttccattgacatgtccattgcgaacgtcaagaagttccacgctgcccagcttgacaccaccgagcttgtggttgagacccagcccggtgtggtctgcaagcgattttctcgacccattgagagtgtcggtctgtacattcctggtggaactgcagttcttccttccacctctctgcatctcggtgtccctgccatggttgctggatgcaagaatattgttctggcctcccctccccgaaaagacggcactctttcccccgaggttgtctacgttgctcaccagattggcgccaaggccgttgttcttgctggaggcgcccaggccgtcgctgctatggcttacggaaccgagtccgtgcccaaggttgacaagatcatgggtcctggaaaccagtttgtcaccgccgccaagatgtacgtgtccaacgacaccactgccaaggtggctatcgacatgcccgccggcccctctgaggtgcttgtgatctgcgacaagcacgccaaccctgcctttgttgcctccgatctgctttctcaggccgagcacggcgttgattcccaggtcattctgctggctgtggactgcgaccagaagcaccttgatgccattgatgaggagctgcatgctcaggctcttgctcttcctcgagtcgacattatccgaaagtgtattgcccactcttctgctcttagcgtcaagaccatggacgaggccttcaagctgtccaaccagtacgcccccgagcatctgattctgcagattgaggatgccgacaagtacgtgcctctggtggaccacgctggttccattttcgtcggagcttactctcccgagtcttgtggagactactcttccggaaccaaccacactctgcccacctacggatacgcccgaatgtactctggcgtgaacaccggcaccttcaccaagcacattacgtcgcagcagctgacccgggagggtctggagatcattggtcccgccgttatgacacttgctgccaccgagggtctggacgcccaccgaatggccgtcaaggtccgactcgacgccatgaagaaggaataaggggtagggtatgattggatgtaaaattatagattaacaaatgaattgagaacagagagtggtgtcttgtgggtgcatcgtagtagagccatgggataacggctgcatgcgatcaagtgtatagattgagtgggtacatttttttatggaatacttcaactttgtgttttagccatcttggaacgcagaacttgtggtaccctagttgacttttcaactaatctcttaactattcagagcagtggattgtacgatacgcggatattgaaggcatagagacgtctacaaggggaagaagttgaggttattgggcttgtacaagtattcagactgtagtatgtcacttccaccaagactctttctttctcatccgaaatcgagcgatccgtgtatcatgctggtgtgaaaactatgtgtatgcgaatcgactaacacaagagttgcatcattgaaaggaaaacgacaggtagatggcggaaatggccatttgtaacagtatcattggctttattggtacttgtacacacttgagtgaattctgtacaagtgggtactggcactggtaatttgtcagtatttttagttttttaattttttaatttttgatttttaaaattcagttttcaattttcaattttcaattttcaattttcaattttcaattttcaattttcaattttcaagttttggttgctggtgcataatggtacagtgccgagggccaattggtacagtgacgactgagccacgaatgggtattcaagtacaagtgccggtatcgtattacataatcagttctacattcaaaatcgcaagactatcgtactgtacatactgtactcgtactcatagtcaggcgcaactaccacacgatatcggaaactactgagaaaactgacaataaaaaggcacgattcgaaagacccggacacaacaagcccattgataccataaaaccccgtctcaccctacaaaaagtcgcgttcggtgctacaatactcactggaggttgcttttgcggggatagactatgaaccaggtcagaccatccattcaagtgagaccaaatcaggtgtctggagcatacgggcggggtaatggcgtcatttcagcccagtattgaagtcgagtgtacacgtggttatgtggttgtatggagtgtgagtggggagcgagttggagcaatctacaagtagcacatggtcaagtaagtgcaagtaaaggtatgaactaagatgtgtacgatacttaaagatccttcagtagtcaacacagcagtagcaatccaagcactctcaaaccgcctctatcgccacctccatcgccacctccatcgcctccaccgctccatcaccaccacctccactccacccccgccacgtgataatccaaaaccgcgtgaaatagtaaaggttgaaaaaacagacaactgaggtaattgagcttaggtgtcgtgtgatctggtgagccaatgcggcgacggaaaacaatcgcaaaaccccggttgccacagaccacatgctacgtcacgtacacagtcacgtgaccccctcactcccgccgttttctcgcaaaacacgttgctacaaccatcacagccgagctttacattttggacatacatgtcgcaggccgactcggagatttttagctttgcgagaggggcgttaaatgtggctcgatggaggtgtttgggggtcacatgggccgtgtggcggggctcagtgtattgtacaaacgaccagctagaaaatggtataaatatctctgctaccgccggcttatttccccacacaaaccccacaatatgtggtgttccggacggttccgaaccacggcaatttcccggccaaccttaaccacttaaaccttcggcacgggggtacaagacacttggagcgtgtcgtcatctccccttctgccccaatccccccctctctcaacaagtccatcacatttcacaatggaagccaaccccgaagtccagaccgatatcatcacgctgacccggttcattctgcaggaacagaacaaggtgggcgcgtcgtccgcaatccccaccggagacttcactctgctgctcaactcgctgcagtttgccttcaagttcattgcccacaacatccgacgatcgaccctggtcaacctgattggcctgtcgggaaccgccaactccaccggcgacgaccagaagaagctggacgtgatcggagacgagatcttcatcaacgccatgaaggcctccggtaaggtcaagctggtggtgtccgaggagcaggaggacctcattgtgtttgagggcgacggccgatacgccgtggtctgcgaccccatcgacggatcctccaacctcgacgccggcgtctccgtcggcaccattttcggcgtctacaagctccccgagggctcctccggatccatcaaggacgtgctccgacccggaaaggagatggttgccgccggctacaccatgtacggtgcctccgccaacctggtgctgtccaccggaaacggctgcaacggcttcactctcgatgaccctctgggagagttcatcctgacccaccccgatctcaagctccccgatctgcgatccatctactccgtcaacgagggtaactcctccctgtggtccgacaacgtcaaggactacttcaaggccctcaagttccccgaggacggctccaagccctactcggcccgatacattggctccatggtcgccgacgtgcaccgaaccattctctacggaggtatgtttgcctaccccgccgactccaagtccaagaagggcaagctccgacttttgtacgagggtttccccatggcctacatcattgagcaggccggcggtcttgccatcaacgacaacggcgagcgaatcctcgatctggtccccaccgagatccacgagcgatccggcgtctggctgggctccaagggcgagattgagaaggccaagaagtaccttctgaaatgagaaccagaggccaagagacgaaaggtcgaatagtggatgcaagatgtacgagaccttttgagtctctttccccagtatgtatttaatactgttttgaatattttctgtattttttaattattttctattattttttcaccaccgagagtgattaggttcaactcgcggctacacgtcataccctaaccctaacaacgccaaaccctaaaatcagccccccaccgcaagaatgcggctataccttattgttaagaggggtacggacgggaccatgttgttggattgctgggtcagggttagggttgaaacggggagcgagtttttctgagcttactaaggcgaggaacggtgggagtgtttggagcagaattggagatctacaaggcaggcgttagtttggagaaggggtcagggtatgggttgtttgcggatcatgttgcagtggtatttggccgtatgggactagtgggggttgcaatgtacttgtagggttgtagtgtgagttgtaggagtgttgctacaatggctgttgtatgtcaagacacgagacatgggttctcgtttttgttgtcaattgtttccagggacagcttagtcgtgctgtagtagtgctgaatcctttcaaatgaccatttgggtggtggtgattaccaacgctttttggacgagattgcaagatgaaaagtgtgctaagtttcgtgaagaattcctgtggagagttctatgacgagttcttatgacaagatatttgcccacaatgggcagtgagacgttactgagactgcaatcagtcctgtcatgtcagttgaagtcagagtgaggacagatatctcgtttacactggcaggtacacctgagaactatctgccgggattactactcgttaaacatctggctctggatctttgtcttggatcgggtaagtcatgaggttcctcaagagcgaattctgtcttgtagtatatgtatgaagaaacgaatcgcatgtttcgcaggtttgggtgctcacaagagtgtctaccagatacagtattgtataaaaccacgtatactgtttgagactctcttactcttgactgaattatcggattcttagaacttgatcctatcgtcatgattagaaatcatagaggggacagtttgaattcgacaatagtcagacactacaataaagaagagagaggttgagtccaacagagggaccgagatttatccccaaatgatacaatctagtgttttctcatgagctacgccatgtgcctgttgatgaaacgaaagtcggctgtatctccataagacaatacaatacccacagatcaggctcgtgagtgttaaagagtgaaggcatagtaatcaggtaaagtagatagcagtttgagaagttcatcggatgaccgttaatcaaatggaatgtgtgaattggtgttggccgagagaacagctctcatatgttcgtgctacatccatattgtagattcctgatttgcgctcggctttatctccagggtgtcattgacgacagtaaaacacgtcagtaacgtagagtagtgatgatttacggtaacaaatggcatcctaatcacgtcatttgttagaagaacccacaaatagagctctcttctttcagtttcttcacacttgttcatctacaccacaacgggacagtctggcttatggttttggatcaaggagacccaatgacttcaacaagtgtcaggaataggcccaatatcgaattgtttcaattcatctcttggttatcttccgtcaattttttttaaaggccgtttttttcgcgtggaaatgtgtgtaacccacccggagacatcacaggcggtttcttggtctagttggtcatggcatctgcttaacacgcagaacgtcggcagttcgatcctgccagaaatcactttttgctgcgtccccgcactatccagtatttttgccaggtagttcttccacccccactttgccgtgggggcccgaggatgactctgggtgatagcactcatcgaggagtctataggagttgaccagatgacaagtctattattgtgattggaataatagggcttagccttcttcttttttgttcttttcgatagtttcgaacattgttggtcgtttctctggattgttaaacttcctgataagaccattgagatgaacgagagtagatctccaccttgttgaattcttggtaccagtcagcgttaggaccagcgttcttgtcagtcctgaaacgagcaaaaatgacacatttatcgggtgtatggacaacatcactttcgggatcttcgaatccaaacatgtagcatactgaacagtatttcatgtgtttagcgtagtccaccagcatgttccttgcgcaatgagctttcttgttcctgaatttctgcctcgtggtgttcctagatgacgaagaaggaattgacatcagaatcactttgaatgctatcaccccactcaatagctgacgagaaagttctccagagtagcaggtcccaattgggtggatgttgcattggttggacatgctcatatcctcggcaaaattcaccttcattgtcttgtagatatctctaaagtagggaggtttcccatcaagaacaaaatggtctgatcggactttgtagttcaaatatttgaagaattcatcgttgttgaacccacacttcgctcggtagagaacgcgcctacttgtaatggggaggactcttctatgagaggtaatgtcctgcttgtttgaatcaagagctctgagatgtttgaaaaagagaaaatttccaaaacgaacattctgaggtgtatacttgatcttggagttgtcatagccgtttctcctcaaaaaagttgatcagattggatgctgatgacggacttgcatgatcatgtaaggcttgaggacagcttatcatattggagaagtggtcgatcatctccgaataatgtagtcaagtatctccttcatgttaacaatgttatcgcaatagtttgcagccgaatggccaggaatactgcagaatccaaagtaccccgagatggtgtcgtagttggtgatgtttgcagcgagtttttccatagcgccgagaatggaagccttcttgaagcaacggaagagagcgtgtttgaaagcattgaagttcgtcttccattcccttttcctccaataccaatctgagatcagtgaaactagcaccaatgctgctaagaatcttcttgtatcgatggggtgagacttgagcttgttggcaatctccaagatggtctctcgagcaaggtcgtgaagaagtcacggacctaaactgctcgttgatggcgtttttgttgaacaatcaatacagtattgcacatactgtagttgagactcttatttaataaccggttggcaattctcttaatgttctgagtaaaaggagagctatgtttagaccaaaataaacagacaaagagaagagaccggccagggaaataatcgatgagataattcagacgcttttttttctctttcctttttttcaggatcagggggaatcatctaaatatggtatcgtaattaaagaaagtgcaaataataagaaaatatataaataaaaaaaatgtaaaaaacactccgacttggaaagtcatagtgaagaaagaacaaataacagacagtaatttcttggctttgattagaagaaataaatgaatgcggcaggaattgcttggtatagtgtagtgtacttgtagttaccaacaccgtatgtacttgctagttgactcttggagtcaatcatattggagtcaaaaacaatagaagctgcaagaggcaagagttgatataaagaatacggataaagcatgtaccttttttgtattattatgccgcctgaagtacaacgacggcatatggatactttcttttttctttttaagcacattttcttttttttccctcttttttgacattttcttttttcgccaccaaagacagttgaaactgattcatagcggatctgtttcacttgaaaactgcgtccaaacgatcccagatttgcagacacaaagatacaggttcccgagcctgatctgatggcactttcaataccgagatagacattggagagctccgtttctcgatagggagcgtgccgggtgctgcgaatctgtggagtctggctcttgctgcctgaaggggcgacaattttgaaggcgacagatctgcagttttatagggtcggacagtgccagtttataaaacattctagatgttcatacgggataataatgttaggagatgacacaggcggttctgttttagttttgtgctcgaagttggggttcattgggtcgttgatggctagtactcaccgtttggagggggccacttcatggccattttccgtctttcgtttcttctctggcgtggccgttggagtcgagttatggtcgggttgtggtagatcgagctcctccagtgctcgttttcggggtgtaattgctggtgccttttcgatctgctctacatgagtgtcgtattcgtcgtcctcattaataatctcagtgtcgtcctctttctgcttttcgatctgctctgcaggagtgtcctcgtccatagtatccatgtccttctctttctcgtcttcgtctcggacatgtctgctctgtctggaagcctcaactgctgctcttcgaggcttgtctgtgaggagtttgtagagaacgtcaataaatctacccatgtccttggtgatatcttgccagtcaaacgccgcagacgtcttgttggcatcgtgatcaaacacatatctgcaaaaatagacattgtctccctttttgtcttcctgcgagagagcctcgaatgcagcaaacgaataacacaggacagggagatgcagctccaccacaagaatatccacaatggagttcatcatgaccaactcttgaccctcggagtacctgttcttgttggtattggggatcacatgcgtaggagtgagagactcagcgtcgttaaacagtttcatcaagacacacctggcctgcagtccctcatctccgtgcttgagaccctggatcaatgcaaactccttgccttccacgtccggatcgtctcttagaagaaccacatctccagcagatatctccacgttgttctggtctctgatcgcgtgaaccgcatccttcttcgtgttcttgggcgtcgatctggcctctggcgagtaaattgccgtgtactctttggtcatggtggtgctcgagacagcactgtggtttacgcgtcgatatttagtttcactcacagcctaatacagttattggagaacctaagtataatttattagatttagttaatgtaacgacttacaacttggtggcaccatgatccggtagtagcacaccccagaatgagattctagataagcagatacacaatatacaggatggacatctcgtctacgggctggttcctctcaggatgtgagaaattggccagctattgccctaccaagtgttatttgtaccttccactttcgcggtaaaccctaacccaacaagactaccaaggggtaataaaacagatgatagaacacagatccagtgacatatattagtttatatatcttgtaactatcatgatagtttctatacatattttaactatcaatatactccctactgtacacattttctttacgatacatacaatcattattgccctaacacctttgtgagtgaaagttggggacggatcgaaacatcacttgttgacgatctctgaaatcttcaggtaatcgtgaatgggaggagcaaagacaggaagctcgggcgcggtgatttagagctcgagatcattggtctggtggtttccttggcatattcatctccaacatacaaggtctggagggctggtagtgaatgagtctaagaagatcttgatcgaggggccagcgacgatctggagacagttgtgggaactatcaggatgactacaagtagtagagctttttggagtaggtgaccgcacttttggctgcatttttggctgcagttgttgcgttgttggaagacttattgttggaagacttatcacgtagtgttcagagattaacgagtacaataagtatatgttttctttctcgtattcgcataagtaagtacatacttgtatcaacctcatcgccagcccaagccagtctgctactgtacttgtacttgtacagctggagatagcagctgactaatggcgacaacaatctcaatacagaaacccttttgagtcaacaggagtttagtacatgtccaatatcgcactttcgtactcactacaatagctatggtatttgtacctattgtttttttatttaatttatttaattttttttattctatatattagactatattgttactcactgtagactcaaatctctcagttgccagttgagtcaaaatgatcagggagcaacctccgctccacgtggatcagaaatttccttctatcccctccttatattatctctacttccccaccatcaccaatatccgtctatctgtttgttttctactttcgatccattttaatccatttttatccatttttgcggtttttacaacacacggcgctgtttaaattagactcggacctggtggggcaaaaccaaaaagatcccgctaaaagtgatgatcatccagagaccgcttggagaaaccaaaggggacgggacagctccagttgggtcatgtgatgggcttctccgccggcaaccgtccctatttcctactttttcggccgcttttgccccctccaaagccccatcaaacaccccatgaccgcccaagtcacgtgcgccttatcagagtcatttcaactctatttccgaccaagtgcatgactgatccaacaagatatatatatctgcactcctgcctcaaccaaatcacaacacgacacaaacacctccagatacacgcatggtagacgaaagaacacccctcaaggcggtgacaacgcgcgaagacgcgcccacggcggtgatgcgtccgaaaccggtcggaaagtcgatctttgcactgtccattttgggcacgctctcagcggcatccatctccctgttctccatgtacggacagaccctacagcataaactgggtttcacacaggtccaggtcaactccgtgtccatctcgtcgttactgggcatgtatctgctgatgcctgtgatcggatacctgggagacacatacggatccaactacttggccctcttttcctggatcaccttccccgcaagctactccatcgccagtggcattttctccaccgccgcagactggcacagagaaaccggagaggccctccctagagctgcccccgaaatggccctgtgcttcttcttcatcggtgccagcacctcttgcatgtactacgcctctctcaaagcaagtgcccactccatgtccgtctactttgcggaggacggcaagctacaaacctacacacctggatacgccatctggggccccgttgcggcctttgggctgtcgtccttgtggcaatctcagttgcttcgagctgttttcatcactggcaagaacgtcaacgttgccggtatctttctctttttcgcaggcctctatgcggtcatctgtggaatcatcttcttttcatgtcgaacggccgagtctatggcttcagagttgcgaaagaaagccgaagcgtccaccgactgcaactgcgacggacccggacacgaaggagccactctcaaggagttcttcaccgacaagaccgcctggctgtttctgctctgctttgtgttcatcggaggcccgtttgagatgtttcagaacaacatgggggctattctggacactgtgacggtggagaacgcggactcgccctctttctccacccacgtgtctctgtttgcaaccttctccacggtttcgcgtctggtggtgggattctcgtcagaggcaatggaatctcacgtgtcacgacccgtgcttctcagtgtgattgccctggttgcagcatgcatccatctgatggtgccttctggaatcttcaccgtgtttgacaacgccaagtacttttcggttgtgaccatcgttaacggcttttcgtatggctcgtcgttcacccttgtgcccaccattgtcaccaaagtgtggggtatcgccaatctcggtactatctggggctccttcattctggctttggctgtggggtctcttggctacgggctgctatttgccaaggtttatgacgctgccagcgaggtgggggtgggctccatgtcacaggtttgttcaggcgtgcattgctacggcctgacatttgtcatcaccggcaccggtctcgctttcgctgctgctgctgtctttttcatttgggtcttcatgtggaagaagcgaggaattcacatgtaacttatattcatatgcattgttgaagggatggctcacagtaattaccagcacaatggactgtcacaagggaagtgtgagtcgacgtgaagctgttacaattatgagtaggtgcaattactctatgtttcatgagaatatgtatggttaccgtccttgcctacaggtacatttatggcttcaaataagatacccctgaccaaaacaaccttgccagaaggtgcttttggtctcggtagtgctatttcttagctcccgcgacggccaacctgtcggcagcatcgtttccggggtttccagagtgacccttgaccttgatgatgtcgactcggtctcccagcctgttcaacttgttgagagtgggctcaatgatgatgtctctgagttttgacaggctcgttattggacgttaccgagccgttgctctgccatttgtctccccaattgttgagagagttgacggtgtactgcgagcccgtcttgatatcgtagttcttgctgtcgtttcggctgtgcaccttggaaactgtcgtggacggcctccagttcagcccgttagttgattgttggcttccggcaacaggtcggctgacgtcatcggattttccggcgctgaagtacaccccgacgctagccctggcgttggacgactggttgttgctgcaggctccgtcagtgtacacagtcagtcgactgctggagctgtaggagctgcgggagctgctgctcttgctcacgcggttggaggaggaggacgagggggacgagtaagatctgtggctactagatccgctgtagtctccagagacatttgacgagatatagccaataggtgggtcgtaaaaacgaacaattgagcccgccaaatcaattgagcacattgcaatggtctctagcagtaattttctcgaatctacgctgcataatacggaccataccatatgacctttgcacgaggggagtgtgcagacttatgttaatttaacatccacttacgagacatctgtgggtgtttccctcatcatagtcgccaccttgggcaacaagtttccacaagtttccacaagtttctacacgacgatgttccctatgtcctgacttctcactcatggatatttttacccaattgggtgttacccggtacttgtagccacagcctctaagctcctcttctatatatatctagagaactcccctatagtatatactgtactagtatatactacagtacatacagtacatacttgcaatatactgcatagagtctatcctctgaaagctacagtatacgatatcaacctagcgacaggtgcactctttcaacagcgcgcctaaccttggatactgtactataactcttgagaagagctttataggtcctcggcaacccagcacctatttctgagtgtgtttccccttggtcagattgtgacacccgagagtgggggtctccgtgtatgacatcgttactgaggaagcaaccttcgtcttcgacaatgttagcgcgctacagtcggatgggcaggaagttatttcagagtacaatacatgctgtacttcttcatcgggggtttagccacatccattgacgctgtctatggccataattaattacatgtgcagaagctcacagccttggagcgaccgaactcgggaaatggcggcgggaggacttgacacgaaatggggaaatggcaccgatcctccaacaagattgtctattgtagacagtttgcagaaagaatgttcggacaggacaacagaactcaagccgcagactttggacgagacaactccaatgcgtagccatgtcctatgtcgcccacatcggatttgaggatggaatatatgttgtttttgagtaaacccgaccgagttggaataaaagggagttcttcaaaagagattgcatacaatgctagacttgcgcaaggtcgtgaatgtactggaccgaatgatctgtcctgtttggagtctcattcaatgccaccgtcagtatacacgagttctaacaataacgctcatctcattgtacgatgattgatattacgctcaataacagaatcatattacaagcatcacttgcaatccagcagatcaacctaagtatgacctcttcattaagcctcaagctcatctcatctaccgaaagttcctgttatcatgcataatctatgctgcttaaattttatatgatttaggtgaaaaaatcttggtggaaacacggcagctgtctcgaaatacaactgtttgcgacgcgatatagataataatacagacatcaatacataccaatacagaccaagacagaccgagacatccgaattcatcaacaaaaaagtccattaccctcattcttgagagaatagccaaaacataataatcagcgaacacccaaacggaatcagaaatatccaatattactgtgtctgtagtcaagtcagcagatctattgctagagatgtggtaataatgtaaatgccacaatgatgtgaagaaaaataggagaacatggagacagattacagtatggtacagtacagcacatacttgtacaagtcacagccacacagttttttctttacgaccttctccaagtaccaaaacccaactacgatatgatatataccgtccagatccgaaggtgacatcagcatcaatggtcagaatcaaccgagacgtcttcccagtcacccctacttgcttgctccagctacacctccataccacctccataccctccgtaaaaacagctccgactagaaaaatacatttatggcactattaaaaaagaaatttgtagaagctctggccacagtattgtaacatgaaacatgattatcataattatgtcttctgcaattattgtcagtttatcgaaggagtgtgaacatactgtaccagtatgtaggtggtgttgacagttaccgaatgtaaagctcgcctataatcaacagtaaagaatggtttcctcaaaacagttatatatggcatgtggtccacatatgaacacgtttccaactcgtagatacattttcctcagaaaatgtattacgtaatcacaatttacaaggcagtggaaactattagcaggaaatctgttagaacccagggcctcaggacttgggctcccaaccagtacttactggagaagctcggtagttagtagtcgaagtgtcagaacaattgttggtgcattacaatataggaaatagggcaagttatataatctcaggatcggcgtccgcaacttccggaactcctccagttccggacgggcagtgctctccaagcggcgtagtgcgtaggttatccgctagatcatattggaccaatattggaccaatatccactaacctttgttaaacggtcaagtacaaaggcagacaaccatggacaagtagaacagagagttcagactattggacactcacaaggaaacaacagacacacaagagcacgaatagccgcggtgacggatcgagtatcactaacctccagtatcaggtttagccgcggccgattagctaccgaaccctaacaaaatcaaatatcgcctggctagctcaatcggtagagcgtgagactcttattccaaggtcatctcaaggctgtgggttcaagccccacgtcgggctttactttttctctttttacatgtgctcgtttttaaagaatatccaataatgcttttgtgataccgcactaacggatacagtactgtgcttgtagtatctggcggatccatgggattatcataactggttaacaaggagtctgctatcggcggataaatccgttgtgtgaattttagagttccgtttaccatgaatacgaatacgaatacgaatactttgttgttatgtaaaccagtcccctttatgatactataacgtgacagaggagcgttggtattgtcgtacttatctaatttttcgagtttcgttccattcttgctaacatatgactgttgttttcgaccgtccatcttgggcgtctagttcttgtagcagcgattgacaccaccataccttcaatgacgacaccttcaaggaggatacctctgtggaagataccaccattattacccattcgaaatttccatttctcagcatgatatatacctccgctgaaccctactttctccctcaccgaaagctacagtacagtaatcaatctgagctttacgctaaggattcgatcacctgaaagatgctgtgctatcgaatgagactcagccaacactcgtccaggacaagtagttgccaaatggagccgtacacctcttaaaatgacgcaatgactgagttccacacgaaactatttgcaagaattgtactcttctcaggtggtaccacaggagtaacacctaggtgagtgtagagcacccttcgacattggtagctcacacgggtgaaattactattctgggtaacagagagccagtacgagcagcaatggacagtattgtacttagcagcaggttggttgctgtgattcagcgaccttgtctgagaaccgccgggaactgtagaccagaactaccagcaaacgagcaacttgaacgcatccagtggcactgtgaacagtgggcgcattccagctcgaaagcgatacttggtcagcgacacacagtaccatgacatgtctaacgagccagcaactgcaaagtgttccaagccatcgaggatctgaacagtttttcagccaacgaccgacgagagccgagtctgtctctgataagagcattggagtccccgtatacgagcaagatacaagctgtcagtcggagatgcaacaatctcattcgaaagaaagaaagtaggctggtaatttacaaaggaaagagcatatgattccgctgagaacaatacaacgaatgaaccgatgagtcccacccaagctatcacttgcagtcgagctgtaggagattggtacaagtacataccggaatacaccaccttcgaatgaaaccgaggtcaggaaaagtgaaggtcgactgctggtgtccaacttgtccagcaagtatgcgagagttccactgaaagcgactgtcagatctgaagattgactaaacatggttgaatcacagtgttacactgcaaaagatcaaagtaggactgttgattcgttgtcacacataggttggagacgtggcaggcaaaagaaaagccattcgcgagggaaaaagaagaattgcagcacccaggattctcgtatggtctcccactacaatactaactgggctctctggtgcttgactatggctgatcggacgggaagccgtattttcaccaggatatggccgcaactgtcggaaacagtgtctgagaggtttcgacaggccaaagaagtcacgtgaaaagaaaaaatatgaagattatggccaaaaaaatcaaaagtctggggggttggttcgtatgactagctgaattgactaataggggaagtgcagttcacaagaatcaaagaaaggcaacagaaaggcaagaaaactcacgttcagtttgtacactccctctcaagaagcattcaatctttccaagaaattcgattccacaggcaattgtccatcacaccttccaccgagatcagtactcttcccagaacactccttctcctgcaagtctgtccgcctgattattggcgttatcatcactgtgagctcgcaccttcttcaatccaataacattagtgcaagaggcgttaagattggtaatgtcctggatcaagtctctattgcacacgggcaagcccctggcatttatccatccgtttttttgccatgttgtgacccacttggacagacagttgatgacatactcagaatccgtgcagatctgatacatgcgattatctgtctgggtgctgagtatttccaaggctctctgaacagcagcccgctcggctctctggttggtttgaagatctcctcggagacgagcggagacattcaaagggttgttgtttccaaaaaaacacaccaattccagctgcagcatcaaattggccgtttcgagggcacgcaccgtcagtgtaaaccagacagatgcggtctccccggtcgttcacgtagctgggatcctgtacgaaccccttaatgtagttgcgtatccgttgagtcccacctggttgatggcctgctgcattgagagacactcctggatgagggatcccgtagcatagattcccgccaccactaggtcgtcgaaaatcatgtctttgatcacctagtggattccgcgccgtgaggaagcgtggtgatgcttggaggacaggtctgattcaaatttgactcgaggctcgatattcatttgtgagcctcccagatatgcctcggcatgctggtagacattgaaccccttccattgggcgtttggatactccgtgatctggtactgagtcacatccaggtgttcatagatatcggggttgtggcccactctgacagagtagtagtttttcattggaacaaaggaacaatacaagtgtcgttaacaagccaattgtcgctgtcatgcccaccgtattcgcataagccctggttggaccttgtagtgtggttgatgtacaagtacatagtagtggcaccataaagttggagatgtcaaacatgggaagtgttcgtgtgaatgtgccgctacgatactggttcaaatggagaggaaatgactgcgagtcctagatggaatagtataattgtatcgacgtttcataacaacggtggcatctaagggaccgttgtcagtggtttgatccgcccaaagttcaagtaagtttttaagtaaactgacaagaaggtcaagtagatactgaagatgatgagggcagcaaagagcagcttaggaaactacagtatatactgtactggttctgtagaagaaaaacacatgtctcatacttctagtacaacaggccaaatagatacacctccctacgtcttgatcaacatagaccccgccaccgtcctcaccctctaaatcaccatcctaatgaatgtatttgtatgattagtaggcagaatcattctgtctgcactccatgcacatgtctacggcgtcccacgtttgactcttctctggttaaccaaatacgtgttcaatggcacccagcaccatgaccacgtctcccttttgcttctgggcctcgtcccgcaccagaaaccgggcctggcgcgacgaaatggtctgtggctttgtggccgagatggtgctggtgctgctcttgcgttttggcgccaccttgatctttgtgtggtcacttcgcgacatgaccgcctcgtgcagatcgtagctcttgtcgtcaatgccggcaatcttgtccataatcttggcaaatgtgcggtacaagccggtggagaagttggcggagtcgtcgtcttcgtcgtaccggtcaatgtgggttctcagcagaatctcatcgtcgttgttggggttgaagacgtagtcgtactcctcgtcttcactgtcgtaattgtcggtgccgtcgatgaagaaggtagagttctcgttacccttgacgccctgggcaccggcctcgtccacgccgggggttcggagaaagacattgtgctggttggggtagtggtcgagcacgttatggtcgagattgagcgccaggcgcgaccgcgagtggatccgcgagttgggcgcccgcgagttggttcggctgccggatcgagagtcgccatgactgccgggccgcgagcctcggcttcgagatcgcaccgccgcaggcagctgggccgccgacagatccagactcagacccatgtcgtctccactggccacccgccacagaccgccctccacgccctccgagtactcgcgcgacattttctggccggttcgaatgcccgttcgcagcaggtccggcagtgtttccaccgacgtgtgtctgtgcagatgttcgttttcgcggtcgggcaggtgcagaatggacaccgaccgccgcggcttctctggcgtgtctttgcccttgagcgacgcactgctttgggctcggttcattcttgtgtcgatatcggcctactgctgctgtgtatgatactgtctggtttctcgtcaaccggtgttgctgatggtgcaagcgctggtatcgtaatcgtacataaaacagcacaccactttaagctaattacgacacagcaatggagcttatctcggtgagtgtaaattgtgggtaaaaaaaggaagaaaaaggcagcgtgagatattacagtagtgtaggcgcagtgacaagagagacgagaccaaaagaagaccagcgtagagaacgactatatagacccgcctcgtcgctgcctcgtcacgtgacaaaatccctcactcaatgtactgtactatactcgcactacttgtaccaccccacttcaatgtaggacacacttcaagtctacataccttataccacatctaaccttattttctaaccctgactaacccctaaccaaccaaaaaccttattataataatgaaaaaaaaggggaaaaatttgaaaccacacattattgtgaacagagagaagaaaacaaattatcataaaattcttcatggctgattgtatccaataatatagtaacatccaaattttgagctgaatttaaggagattatacacgttttttctcacttttgctggatttccgcaagatatgcaccttcattgcaggggaaactctgcaactggagtcgtgaaaggagaaagttgcctatggtcctcttgacataatcacgctatattcagtggtcgaatccatgaagagatgattgatgctgactggattgaaaggcacaatccctctcatgatgctcataccatcattttcatctttacaaccacttccttacttttgttcttggtgagggatgaattcatatttataggacttgtccaaagggtatactattatagagccatatgttttgagaagtcctataatataggttttatacaaccatatcttgattttatgaaaaaatgttgttcacagaccgatatgaaggtcaagaagttcattgtgtaatgaacttcatttttattggtttggatcctttgtatagtattcctcccaacattgtatatgaaacttcatttttattgttttgggaccttcaggtagtattactcccaacaataataatttaaaactatatctgacgatactaatttatatggcgtaatacctcaaagataaaagaaaaaaggtagacactagtggcagaattccttgatgaaggtctaccgttagcagttgggataatcaaacgtgtttaggaacataattccattaagaagaacaaatgacctagcagtaaagctagcacagtaaacgattggcaaatccctcaatcaaggaattccacatccatgtataacaaatctcataaatagtactagtagtctcataagcatgtctgattaacatcttctttcagtcacctcgtatatcaaaaattctggtccctgatgcagggcttcacataagtttgtcgcgtcttttgagaattttggagactgtcctttggtggaacgagctgttttagtcgcgtgtgacctccatacagggactgaaagtctattacatgtatatatatatatatatgaacagctgtccgcgcagcacgatagtaacattttaaaacatttcctcctgaccaacaagcagagggtccatcccgaacacaatggaagaacttccacgtgcaacagataacgctgaccgcatgacagaggaacttgccagcagagacatgactacggtttcccgcaccaacagcactgaagatgactcgggtcatgatgatgatgagttggcgtgccctgagcctaaacaccctattttcgaccatccagcttacatcaacaactcaccctacccacccgtggttaaaggctacactagtgaagcatccgcagatgatgtctggaaatggctagacgttgcagcgcgaaggcagttctttgcgcacgtgaagctaccggtaacatctgctattgtatgtgatcgcaagatctcgatcattccactggcatgttgccattcaggctgtgagtatcgcgtgagtattttagaacacagtgcagacagggcagaggtcgcatacaatgagttgaagatcctcaaggccatggacaaacatcagcacaagccacgcgatatcatcgaggaagaggagacattcagtttgatcgaaaattgtgagaagaaacgacgggcagcgagggagtttcatgattacgcgacactgcctccctctgaccccacatccatgaaatggctggtctgggatggaatgaatgactgggctgagcgtcgtgggtttggttacattgagagctcaaatggtgggacaaggccaaatatgaaaacactctacaccttccgatgcgtatttgatcgctgccctcacagagtcaatgtgtgtcacgatgggaaaagagaaatttggtacgtgagaccaccagaagaactgcgtggtcatgagggacacaagatgcatgcggtcgagccgtactgcaatgaggatggctacgatgttaacttcgaagggatgtccaacgaagaaatggtgaactcggaactccgacaagaggatatgatatctcgtgctcgggctcgtgcaagtattgacgccggggttgcagcgagctatctacctcagctggatacatttgatagcctggagctattggaagcttacattgatatcttcagtgcatcgtacaagagacagggcaacccttcgcctttcaaatggaaaaggacctctacccatcggtatccacctcttggtcttacggtcgaagctgaggaatctgaggagcctgtgcccaaacgacggagatctaacagagatagcaatggcaatagaactggcaagccttccacacctgtcaaagcgaagaaaatggctcctgctaagagaatgtcttctattcactacagttgcaggaaaaagtcagtagacggagttccctgtcctcttgctatcattgcgggcgaaactccctgtggtaaatgggagctgagatttacgcgaactatggatgaccataaccattaactgggttgttttttgtataattaaataaaatgttgatttatcgatgctgtctacttcttttatagtacatctgtacatagtggtaagctacttctaccttgtcacagtggcaagtggcgatgttggccatgttatcagtcgcgcagtgtggatgtatccgattcagttttcacgcagccacgtgagatcgtttcccagtctcgtttgttgtatagaataccagaaaattaacagacccctcccaatttggtaaggcgtgtccaatgatacaccatgtggttatcagagtacttgtaggaccctatcgtctacaacacgtgctttacattccgtttcgaatggcctaaaggtttaagttgtcccgtcgtcaaattacgcgttaacgcgtttgtattgtaacactttacacagaatgaggagatgattaatttgcaagtactgtacagtacttgtactgtactgtacgtgataattataggtatattgtacagtacagtacttgtacttgtacttgtgcaaggattcgtgaacaatatgtggggctaattcagcagtcataagggacattgtacatatacttatacatacttgtacttgtacgatctactgtaccttactacaagtacttgtacaagtgtaaattcccacaggggggttgactgcttactgtagattgcactattatattcgtgtcatagccctgggtcccgtatgagaacagtatgtacagcgatagcgatatgccttcgcgtatattgatttttcatgcgcgtccatgcacctggacgcctatgcgctgtacaagtactgtaccttaccctacgccctacagcattattgtagttgatctggaggcgaacagcgaacaatatacgaagacaccctcaacaataccaatgatcaacgccaacatgccagggcagctaggaccgccggtgacacaccagccatttcagcatacaggcaacccgcctgttggcctggtgaacaggccacccatacctgataatccgatgcagcgagacgtcctcatccgaccaccaacggaacaccaattcatgtatcaaccaacggcagtaccccagcatttttaccatttccgactcgactataaagtgtttgtctatctccgcacagcagacggcaaatacgaaaagttgaatactcccgacgagctgaaacacgtgcaaatcggaattgataatatcgacgacagaaatccttacttgaacttttcagtggagaaccctttcatgtttccgccggttccggaaccgtctgcgtgcagtgcacattttccggagcatgccccgagtatgccacagcagcacccacagcagcacccacagcagcacccacagcaacaaagtgccccggaaacatctctttccgaaccaattgatgtggactcaatggatgtagaagaccctgttgaaagcactgtcaagtttaccccatatacaccacctggatctgttatcgaaactcctccacagttggctccccctccagttgtcaaatcgcaacctcgcaaatttgacgacagcaacgctgaacaaaaaagaatggacatcatgaaaaaactcgcagagtacggacgcgagttcgattattactttgagaaagttcaagctgaatttgattataaaatgctccataccgatctcactgtgccaagattcaaagaaaaggccgaagccatcgcttatgctcagacaactgcacgactccatggcttcgtcttacacattggtggtggaaaagctaggaatattctccagtgtcataagagcaagtatgacgacgagagtggagagattgggaaaccaaccaatgcgtcaagacgggtggcatgttattgtcctttccagataagagtaaacaagctcggcccgaatgactttggactggtttactgccatgagcagaaaaaggatgaaaatggagacgccctgtgtgcgaaacataaccacaagccttctgcatcagtttctaccaacggtgcctaccggcagcttgatttggccaatatcaggaagggatgccgggacatcgatctttttgacattctggtcaagacccagacatttcctcgcaagattctggatgctctgcgtctcatttctcctgctgcatcccgactcactcgacttgacatcaccaatagcatgcaaaaattcgataaggaggtttgtggcgatatggacccagtcgaagcgctcttgatcatgttggaactctctcctcagatccatgttgaacataggatcgtcggttgtcctgcagagattactgaagaactgcttgaggaagatcgtcggcaggaaaggtgggaacctgatatgtatgacgcgtctgacgcggaagagcttgaaccaggtgtggaccactttgagaccgcagacgaggacggtggcctcctggtggaagctgagctgatgtcagaaactgaggaatcggactacgtagatggtgggatcgaaaacgaggcgacggacgaatcagaagacgagtcagaagatgaggagattgtggagccgcttctacgaaaaagaccgagacaatctagtcgacgagtcccaccggagccaatgccaagcacaccgccgccagaggctaacctgcctgaacaacccgatgttatcaaggatatattcttcgttgtcttgaaatcagtgaagatgctcagggctttctctggtgttatcgctatcgatgttactcacaacacaaacaaattcaactacaagcttttcaatgttattggcattgcctcttgtggtaggtcgttcaacattgcccatgcacttatttcacgagaggatgctgatactttcaagtggtgcctcgatcgcctgaaagtcttcctacagaagtacctaattcccgacccaggcgtgatcttatcagattgtgcaccagccatcaaaaagggccacaagtacagtgaactcaatggtagcaacctgaagctctgtctgtggcatgctgctaaggcagtcgagagaaaaggttctgctttgtttggttcgaaatctcttgagacagctcaacttgtttcgaaattcaaaaagatgtgccatgctcacacagcggacgagtttgaaaggttatataccgacttcaaactaacctataagaaggagggcatggaccgcgctgacaagcatgatcgctcaattgatggaaggagaaactcggcatactactacattcgacgatattggtttggaaacgaccaacacccgaaacatcgtcacaacattgtggctgcctattctagagaaagcaacttcttcgagacaacgacctccaggatagagagtattcatgctcttcagaagagtaatatgaggacaagaattatttctctcttccaatgtgcaacggtcgttctgcgtacctcggtcaacgttttatgcgaccttgaacatgctcatgcacgggagatggagaggtatcgcaaagatatcgacaagaaattctgcaaatctatccggactttcatttccaccaaagcactattaaagtgtatggagcagatctctgttgcttctcacgatgactacgttcctacggaatgtactggacaatattctttggatactggactcccatgttatcacatgattggtcatttgattttgtccgacgacggcagggaaaggatgcgacctagagctgaactgggagacaaaaaccttggtccagccgtgatacaccaacgccgagctaggctcatgctgggagattttgatcctcgttggagatacttgcacaccaccgcacagatgaatgaaagtgattgggatgatgcctgtaactatggcaagttcagagaacggtgggaagcgcttcgaaaatccgagaaagagtggaagaagagagacgaggagctcgcaaaagaggtccatgcttatgttccgcgtaatggagattgcgtggcacacatggttgaggacgaagttgttggtccgagacggagacgcgtgggacgcgtaaaagcctccaacgagaagaaggctggcccgaagtgtcagatctgtgtgaaccaaaggcatgctacgagtgcacactgtttcagggataaaggcggtgacaaggcttaccgcgagtggaagaacggcttgattcctcgcaggcagttcactggccatgtagttggaggtccaaagcgaattcggttgtgtcgtcattcaagaaccatgatgacagcaacaaccgcggacaatcaggacagagaatacgccgctggataaactactcagttcaagtaatcaatacattgatgtgcatttatgaacaagttgaaccgttgtacaataactagaagcccgagaagctatctgaaataccagtggctctcaaaattttttttccgcgctatcgcgcgttcaactatgcgaactgcttacagttcagtaattatgggctcacacttaggtgtcacgtttcaagtggcccacgacgtgatgagccattattatctatgaacagtgcataaatgagaagtaaacccgcacaaacacctggatattacttctttcagctcagtgtctttccttaacaaataagttaacgacttgggtagcagtttacttaaaaacatacgtaagtaaatctaaactacgtttcttacaatatacttaagacatcagcgatgcattagttttaggttaatatgcaagttatgaaagttaaggagtgtagacgggaagtgaacccgcttcaatgtacattttctcctaacgcaggtatgcacactttgatacatgtgtttgtatgcgtctgttttattgcggggtatgatacttgaccatgagagtagacaggggtgatttccacggaggctgaggttgatgggagttgatatgggagtgagaatacttacgcgtgattattaatacttattcgtgcttactaatacttattcgtgcttactaatagttattcgtgtttactcgtgcttactcgtgtttactcgtgcttacttgtacttactcgtacctgttctggtacagtagcagcaggttttggagactgaggtaagtccaatattgtgtggttacaagtctagctacagaatccatacctgtacttgtgcgatacgtaacctatctgtcacctaaaggccacggattgaatattgtatatcttgaacctgctggacgaacaatcagatcttgtactcttaccggtatgtactgttctgttgaagtctagtccacttgtacgtacccacgttagaaataatctctcaatgtctccatgtctccatgtctcaatgtcttaatgtctctcaattagcgcccttgaattgacacgaattattagtcggcgatgaatactcaggcaacagatctgaggtattttctgtttccatcgacggcgaatctttggtgatttgggcagtcaattggacagtcaactgaacaatcaattgaacagtcaactgaaaagtgacttgaacaatcaactgaacaagcaattgaacaggaatatgtctccttgacagatctacaagtactcgttcaatacatactcccatacactatagctactgtagcatgtacccgagtcgatgtacgtacaaggataatgtacgactcgaaagttcattactcatggatccgttaacttcagcctccccaaatgagccatcttcattagcccagccaatactacgttcccgcttctatccaaacttcattcactacatcaattgagcctgtgttctgtctctgtggagggccagccaagtcacaaatcgcatcagatggactcaacgtcgaggcggcagagaaggcctcggtggtcgcgcattagctagcatttgcataaatattagtatgtcttttgcctgaacgagcataggaagccagtctaagcatcggggttggccacccgcagaatcttgcgcgagtagtcctgctcgtcggcaatggagccctcgctcattcgccgctggttgatgagcgcagggttgagccgctggtccacgggcacaaacgcagaggtgccattgtggctgaagttcatcttgtcttcagctgcggtggtgaacgggtcgtcggtgaagccgtaccggtccgaggcctgtgtctggtactcgtacgactggcgtcggcgtcgcagaatgaagaatgctagtccgaccagcgcaatgccggccaccacgccaatgacaataccggcaatggcgccaccggaaatgccaccggattttttgtccttctcctcctccgtgagcgctcctgcggtggctgaggccgagctctgcgcgtccgaagacgctgacgtcatgctggtgcccgatgtccgcgtgggtgacgtggtgggcgagcccgtggtgtgggaggtggagtctgacgacgtgctgccggtggtggagtcggtggagctcgacgagtcggacgaggacgtcgacgtggttgtcgtggatggcggctgggtcgacgatgtggacgatggcgtgttggatgaggtgtcgtcggaggagctggacgagggctgctcggtggaggatgatgatgatgatgaggtggcggccgcgctggacgaggccgaagatggggtggtggcggtactctgggccttttgggtggagtacgagttgaccacgggcgagccgtcctggttagtggcctggtaaaagttgaagaagagcgtgttgccggacttgcctccacagttttccgcggggtagccgggacaggggttgttgcacatttctggcgatgcctttgcgcccggcgccgggatggagccgccacaccagcacgatttctcgttgatcatgaacacggccttgccctggctgcggcactcgtcgttgcatgctttggacgacatgaagttgtcttgcgacgcgctcaccatgtctgtggccgtcgtgtcgtagcagcccagcgaaatgccgtcggcgagagccacggtggccgccgatatgagccacagagtcgagatgcgcatgtgagatttggtcgtggagcgtgggtaagtgagtgtcgtctactcttgtagttgtggtgcgtgtgttggattcgggggggggggactgtctctgtctgtgtaacgaatgtttggtggtggtcgtcccgatgagtcaatgagcgtgaggggcgaggcgtgaagaggtcgggaacacagatagttggagagcgctctatcgcgtagtcgaatgtcaggatgaagagggtcgcaggggaatgctgggctttcaacaaggtgcgtggtgaaccttaaaaccttcctattttgcgtttcacttgaatgtgcgagcggtggcacggtacgagtatttgtagctactggaggccgacgacaaccgccatgtcgtgggcaaaagacataaatagccgggctggagacgggtcaacaagatgcgctttactgcggtgctcgcactgctgactcgatccgactcgtcttggtccactttaactttggatatttttattttcagagttgtcgctgataatctgccctcatcagaacaccatcattgtcttggccacgtcaacgtgtcaccgtcgcgcaaagccacagtcccgtcagcaagcgccaaacaagccttagtcatcaccaatctcttggctcgtcgtctggccccgctgctccacctcccgcttcgctgtgggcacccgctcgcttgctcacataaagttggccatcgcgacggcgcatttcgcacctcttcttcgcaccttgaggttggagcgtagggctaccgagggctatgtgcaacaagctcggaccagtggtagtatccacccaaacggcggttgcatcagcgaggtggatgagcagcgaacaatggagattgtggctgtgggatatttatagcatggctgatagggacacgctggagagaagattgccgagcccaaacagacgagacggagaggactaaacgccccaaccttgcctaacgatgccaaacttggccaacctcgtcaaccttgtccctcccgcccttttactccctcccactccccattcgacctcacctgtcgctgcagctcatctcattctccaaatgagcccctgaacccaaacgggaaatggcgagaaaaaaaaaagtgcattcccaacctctccctatgttgaagtctaaggccgtttgacgcgacgcactacaagtacagcacttgtacttgcgaactgcactttggcggcatgagacattggcattggcaattgaggtggtcgtgtagactatccaccagaataaacggaggagacagctcctggagcggtggttacgcggcttgtcaacacgaccgttttcgacatggttggacttttccatgcacattcttgggatgcacgcggaggttagattgggtagggcacattgccggacagcgagttgggtgagacgacgacacgacgacacgacgacacgatgagttgggtgagtacgagtaaggcaaccattgacacttgctcagacggtgtttgtcgtattccattcattgaaaacgccatgtcggtgccggatctatcggaccacaccttcgctacatacgagtacgagacacccttgtcgaggatgtcgactatgtactgcatgtgtatagtcgtatcttgagacacacagcgcgtccattgtttcaactacacttccaagatgcgaccagttggcgttggtgggagtaggtcgaggcattgtctcgctgtattttgattttgcgtcttgtatttggactgtcttcgtactggtactgtattgcgactatcttggaacttgtaccgtattccgacaatcttcgtactcgtactgtattccgacactctatggacattcgactgcactatttagctaagaacctgctcttagcaacttaatccagtgtcgaggttccagaaatgtaccacgcttcccgatccgtccgctatgtagatctctgcaggggagcagaggttgggttggaggtgtggtaggtggtagagtggtagggcgattaagggtgagtaggtgaggaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagtaggaggagcaggaggagtaggggagtaaaaggcaacttgtgcctgcaattgtgtatggacttggttttgtacgtacagtatgtcctcacactgtacctcccctccccttgccctttctcacgacagtatgtactgtattaatactttttattatcacacgattaatatgtcgtggtgctaaaaatataaatagccgccttttccacccgccaaataataactagtgtttcgcacaaagacacgctgaaacagccagaaatagatccgactgttacccggcgtcgacgcaggtccctttggccaacctcgagttgactggaccgagttgctggaccgagttgacaggacgagaagacaagtcagtacaagtacaaaatcgtattgtacgttctctcgtagctgaaatgtcctcctaccatcagaatctccatgaatccattaacaaacctccacaagtcaagaaacacgtacatcagtgatacttgttgtcgagctgcaagtagagtacgagcgctacgtatttaaacaccatctgcccatcctcctcttctcctttgtccccaacagaagaggatcatagctgttccgtgtccgacctcagtaacccagggataggcaacgtggatgcaggtaacgtgggcgcaggtaatgatggtgtcataggcaacaccggttccattggcatcataggagccataggaaacataggggtcataggaaacgtgggtcctacaggcaacgtgggcggcataggcatcataggggccatagacaccataggggccataggcagcattgactccatcataggcatgggctggtacggaatggggcccggttggtaaatagccggtcgctgaatcgtgttggacatgtcagtgagcatctgaggagtgtcgggctcgtccagttcagggataaacgtgctgaaggattgtgcccaatgacgaaactcatctggctcgacgcgtacccatgacttcggaggaaggacaggggacttcggaggaggaacagggggcttcgtcaggcctgtcgtgttggtagagaaaggctcatagtcgaaacagcccatatcgttaccaacagctgccatcagcttgtccacctgccacatctgctgtttcaccatggtctccattaccgcggcgtcctccttatatttttgcaactcggccatatacttggtagcacgctcgaaagatgcgtagccgctgaagctgtctggcacattgcgggtggctccagatccatcgccttcaccgactcacccgctctctggctcctcgcgcccttcttcctggctgccaagtacggcttccggttgaggtgcttctcggactggagtttcgcaagattgccgtggaccggctcttcgtatggcgcgtcgagaacagcaacaccatgcgctttcgacgcctccagcagtctctgccactcttgtgcgtataaatggagtccagaactgccaacttctccagtcgtcatgccctcatgaaaagcttccacctcctccgccgactcacccatcatcttgcaatccatgccaaacacatcagtaaacatgtttctccggtgaggcgagaaatcgcgaaaacaaagtccacctgatggtcgtagttccttcacctgccggatagtgtggcggcacggaataccgaccgacctgacattggagcacttgcagtcgaggtagtccccgtcttcttgcgtcgcgcgtatctcaagaatacgctgcaacgcgaatggcgatatcttgtagaacacatcattaaaaacacccgccgaaacgcatctctggtgcaacgacacctccctcagtgccttggccatctccaggttgttgaactcgtagatcagcttgattttctcgagaatcaacttggtagtctcgaagaggtctttcttcttggaccccaagaccagcttgtactggtggtgcatgctctccacccgagacgccatgttgtggtaaaagtgggggttttggtcagtgtagaagcgagccagcctccggaacgtggcgtcgggaaaccactgagcatccacgtactcaatgaagttgatcgtcgtcttcttcttggtcttcctgttcaccttggtaaggtccacagaaaagttgttgcaaaagtaagccttgcaagtttccatgccctcctcagtctcagcagagataaagtcattccaagccttcatgaccttgtcgaccttcctcttgcccttgaagtacctgttggcgtgctctctgatcttctcgttacaatgccagctgctaattccgacgggcacattgaggaacacactctcagaagcggagatgacctgtttgccgccgtcggtcacgacgaccttggggtacggaatgcgatagttgtcgaacatatccctcagttgggtaaaaacccatttgtaggagacttgggtttcttctgcaacaaagcagcatgcgaacgggaaactcttgtttagtgcacaaactccgctaatgttcactaaacagtacttgttccggttaaaaccggtgatgtaggttgcatctaccatcacaacttcggaatacgccctccaaaagcgataaccatcagtgtttgcaaagaacaaggctggttcatgtcgcccccaagaggattggcgtagctgtcgtcggccttctctgtagtgatcgggtcaaacacgtcagcatcagcctggaccgcaacgccctcgcgctcgataaccacatcgtccttctcaaagtcgaacttgctctgctcctccgactcttgtggctcgtcggccaacgtttcttgttctttgggtggcggctgaaagtagttggttcgaactcgcatgtacttgacgcgccctagcagcgataagaccgcttcgtgaggtggcaggttttcacgttgttcaagcctcctcttctttcttctctggtagtaggtgtagttcgtcgcattcacggccagcgggttggtggcacgcatatattctcgctcttccgatgctgtcatgaactgaatcggatccagccgttcgtggccaggcttaccgttcagcttttcctccatctcctcgcgaaacgtgtcaaagacttgtgacacgttttggacggaagaatgagctccaggatgacaactaggcaggtgtgcgtgtctgcagcctccgccattcttgccccagcagtggctcaacttccagagaccagacgactcgtccagcgtacacttgaaacgaaacgagcactcctttctgccagtaaacgcccgtcgagtcgctcttccatcgacgaggaagcaaccgtctccgaaatcgtcctcaacctcaacagactccttcgcggctttctcagccctttggtgcctccacaacctgtactgctgttccttgtgtgtttcaccgccactggtctcatcacaaataaaataggtaaacgagccaggcttgcctccacttctaacaagcgcgtaatgcctcgtgtaggcatggattcttgcaaacagatacgcatcctccagaaaatcaaaccatccttcagggggaagcaggtcatctggccacacattagaaaccggaggataatggaccttgagattgtgcaccgcggcgtcgatgtcggtgtcactcatccccaaatgacccatgggaatctctcttaggtacttgtcatagatcatctcacgtgtctagtgtacatctgagtcaccgtcttccttgcccatgtgctcaacgaatcgctcaaacccgctgtccgccttatcgtcagagagagactccttccacagaaaccagcccaaggcgaatctcgcgtagcgccagagttggtccccatcttcaatctctgtcctagtcgtaagaaaactcacaagctccgtcagatgagctggtaatatacctgcggcaattccgagaaaagacaccaggtcatgttcgaggaagaaaatgggcatcatggtgagcaacaggtggatctagtcattctggaacacagacagagcctccaaaacattgcagaaatcagatcggtcgcagagactcccctgagacatctgaacagaacaggtttccatctggacaacgacgattccagcttgttgcagaaacctcgcgcacttgatcttgggcgtaagtgtagtcatctgccaactgtcccttccaccattttttgcgtctctcggggcgggcgattgtgcaccttatgataagtcctcagcagactctcatacttgtcgccaaccagaagttggactttgtcgtcgagtgcaatttccatcgcgtgagtcgcccttacgttgaaattatcctaattagactaattaaaagcacgtccaacgacgcgacgcgtcacaacgttgattactaatatccatgactaaaactccaaaaatgacaaaaaaacattttgtcctgaccctgaaatccataaagtacaaacaatgtgccctagcccacttctcatggtgttttttgtgattcccctattagaatcacgtgaatgtattactaataactctcttctctttgccctgattacaattctccttgccctaacccattttcaattttctttttctgtcacccctcctcccaattacccggctttaccatactcaagatttgttgctaactgcctacttgtagatcggccctgaaacctgtagcaccaactaatgccacagatgagaccaaaatagtgccacaagcaccgatgaggcgtcttccactatcgtactcgtggtctctaactctagatctacatttagaccattcatatacatacctacgctactactcgccacctacaataccgtcatactaatattcattgttcggatggctattctacaacatgcttgccttgatatcacgcagctgctggagattggcttcggagtcacgaatggcctcctcgagatcggcctgcgtcatgtcctcggcattgtcgcctccgccggcagcggcggtcttggacttggagaagtcaaccatcttgggattggctccctcaaacggcacaaagaaccggccgggcgttcgttgactcttgccaacccgctcgtcgatccagtgccacagctcgtactcctcctccatgacgaaaatctccagcttcttagcgtccgacaggccagcaaaatcaaacttgtgcgtggtggtgtggtggcctcggaacaggccaatgatgaaccataacacccaaatgcctcccaaaacagcccccacaatagggaggggcagggaacccagaatggggatctggctccaggtctcggcaaactggtggagagctccaccggtctgaggagggggggcggaagaagacgacgcctcttcgtgcgcggcttccaccttgtggtgatggctcttgtgcttggcatggcccttcttggtgggaacggccaccgcagtcgcagtaacaggcttggccgacttgccagagcccttggcccgctcgttaagatagggaatcagatcagcggcaaatgccatttgaccgtcgtttccacccttctcaatggcactcttgatccacgacttgccggtccagtcgaaccagcacgacatcatcacctgagtctggttgttggcggcccaggtcatgatgattcgggtcttggtggtgaaagcgttaccagagggaacgtcgtggttggaagtagtggtgaccacattgatggcccctgtgtcgtcccatgcctcgacattgtcgacacactgacacttggtctgcttgggacccaaggagttgttgagcggcttgacgtagctgtactctcgtttcttggactcaacgcacgacttgatgggcgtaacgtcccagcacttttggttgtccttgaggaaggcaccaagcacgttctccttaccaaacaggagattggcaacgacacccaagggcgctttaacaatctccttgcacaggagcttctcgcccttggcctcgggatcgtagccaggcgaggtaggcgcgtgggtctcggggcccaggttggggacgctccacttgctggcgtcggcacccgcttccgcggaagccacgacggcagccccggtggcggcggtttcggcttcgttgtcggagattccagagtcgagttctccgtcgtcagagtctccgtcagactcgtcgctgccagcgacgccctgagagttttgtttccagattgtgttcataaaggcaaatgttgcgtctcgcgaaatgaaggaggcgtaaatgtaggtggagtgtagggtctgtacaacgattccgttggggaaaagaccggcggtggttttcttgtcgagagagacgatttcgtcaaaggcaatgacgtggtgggtctgccagccgagaatgttagcgaagaagcaaatatgtcgttcagacacaaacatacgaccctggaccaggatctctcgggaatatgcgcagctaaagtcgtctagcagaaagtcgtcttcgggaacggacttgaagtgtgcgtggaactcctcgtttcgcttcttggatgcgtatgcgaagccggtgatggaggctgctgcggaggtgaccggggtgatgtcctcgggggtggctgcggtgtttgctacggttgcagtggtgggggtgggctcgagctctttagcggagtctgctcgttttcgggatgatccgcctcgagacagtctttgggatctcaggcgtttgacgacgggtaggtggtcgtcttcaatgtcggcgagttcggtcttgaccttgtcgatgatacggccgggaattgctagtgggggcgagagcgagcgacggtgttcgctggtttcggtggctgcgcgggatcggccgttgggtgtggacggcgacttggtggacttgaccgacgtgtgggagccctgggcaagcggcgacttgtgtttggacgacgagccggtgtttgcgcgggagcgggagagtccgagttgagcgagagagaggtcgccttggccgagggtttcgatgggggcggctgctgcgggggcggccggcgagatgggcggtgtgtttgtgttggagtgcgacggggcgactgctggggaggaggaagaagatttgtttacgtttgcgttgtcggagatagtggtgggagagtcgtgtcgggggtggttgtcctgcctttcggcgccgttcatgatattgttggctgcttgctgggccgcggtgtacacggacgagaagaaggacgagtcttgcggctccgcgtcctcggcgttgttgtaggtggtgctggtgttggggttggtggcgggctcggggttgggggttgaagtagcggctgtagccattctagaggttgtgtgcacgcgggcttttgtgtcagtcgagagcgagggcgttcgggatgcggagaaacggcctcagactggagactcgggcctggagtgtcgtagggactggggagcgtgcgttgatatggcgctggggtacaaaagtccgttaccgaaaacagcaaggcgaaggttaatgcggagtggaggtcagtgataaagtctacttgtgctgtagttgagacactgtggtgtgaaggtagattagcggggcaaaaaaaaaaaaaaaaaaaaaaaaaaaaaggcggacggggtgtcacgggactgaaggtggtaattgggacagaaacggttggtggaacagcctgagaaaagaagtaacgcccgcggacgccaattgctcgccttcttctcccccaattgctaaatgagccattttactgcccatccgcttcgctgcttccgaccccgaaagtgtaatcgtgcactgtaaatgtatcgcgagtttatctgtctgcgaggcatcgatgaggttgaatggaacatttggagcgggatgtgtgagccataaaacgccccatggattgccgcccagggcccaattaactcgctcgccagcgaagcggctcatgctaccgccccgcaccctcttttccccccaccggtcggctgacacacactagccagaccggaaataacggtctccaaagttggcggttgagtttgctcgagggaaataattggacataaaacgcttaagcccggggaccaattggtggcccgtgaccgtcgggttgtgtgtcccacattcaagccactttggcgcagttcggccctgcccggcccaagtgcaagcagcaactaatcactatagatgtaacagcaattgcatgtgaatggaaaagggctgctttcccatacgccaaagcaacttgtcggagattgcagctctgagacaccgtatagacctcgtagacccccggtgaacttcagggtagcttttcggactcctttcgggctccttgcgggctccttgggagctccttgcgggctccttgcgggctccttgcgactcaacatgtcgttctgcggcgtcgtatgagatcgcttagctcgccatggtcgtatctccagtataaccacgtcgttaacgtccaaagacccaaactaaaacaaccaccgctcagctgcgtgagccgcatctcgggctctcaagtcgcccactgtcttgtatgttattgcttctctgcgtctgtctatcactaccggtccttgctatgatagcaatggtgtattgggggagctgcagcacgtgttgagggcccaagacggtttgaagacggcaaatttgtgcttttccactagcagctatcataaatccggaaaacagttatcgtctgcgttttctcgtccagacggtgtctacggtgggcactgatcggcaacgttgaacggtgacgcagaaaaaggaaaactggttgccttttccggtaaatggaaaaagaaaagaagggcaaatcgaccaaaaagccgatcggctgactcgccgctgagatctccctactcgagtagccttgtcgacaggctttcaagcccaccctttagctcctttgactcaaggtcgcactgtatcgagcaccatgagcgatttacgagaggccgccaggcgttaccagagatcaaccgtgtgatagtatgtacagtagaagagtacagtaggactaaaacagacgatggtggtgcctgagacatggtaccagagtgctttgcagaaggtcatcagcgccgcgcaacgagaaactctagaactggaacagggcaaacgtgaccgttgattgagggcaaccaacatttcgtaagacatttccaatttcaacgagtctttaggaggtttcatgagcaatccacagttgcgggggtgaagctgacagcgatcgaggacttcagacgtcataatggtatcatgagggtcggtgggcgaatgcttgtactactctactagttcttctactactctacgagtgcttgtaccagtactcgtactgttcttgtagttgcagtggtttttggctctcaaaggggagcatatctccgtctaactccgagcatcgatatggtggctcaaagatggagctttcgactccagtcaactccgagcattggattttcgtgggttttgtctgagccgttgcgacaatgacaggataatctcctccagaaagttttcctacccagataacggcataactatgagtacaattatataaactgtactcgcactcttcctcgcacttccaagcccagttgatgttttaattgttgaatattaagaacttttgtatgataacaaatgcattgacgacttgaacatcactttctaggaggcgttacgataaaccagcacttcgctcccccagagagactcatcaggagagtccggaggattcgactgagcacgtcttgaggttcagctgagtccctcggaatggagactaagtgattaatcaaggctttccattcaacataaaacagagtaaatacgaccggtacttgtacgattgtgtcacctatccaacttctctctctattattacatacagtaccttcacttttgttatcattatcactaaatgatgaacggagagaccgtgttcctgaggtaaatcaactagagtaggtgaaatcccctggtctgagatgtcttctattcctctccacccagagtgtaaacaactccctaaggaatatctccacgggaatggactatgtgcctagcagacatgtgttaactgttaatagtataactatatccttctcgttatcttctccttcttcccatatatttctcatcctcctcctcaccctcctcctcctcacccacgtccattgtctagttggaacactcccttatcgacgcacttgatcctacctacatcgtcagtctggtaaaacctgtcaaagaaaatcccgctgcaatctatctccagcttcggctttcatattgaacccgttttcagaatagtgactgtcctgcgccttgctcctgtgccgtcctggccgccctacttgtagtagcaagctcctcgagtctgccagagaaccatgcacaggtgaaaaacgcacaatattgagtgggagacaataatgagtcctcacccactacagtacaagtagttagtcagttgagggagccccatggtacgtacttgacaaccagatcgagttcagatgacccgacaactgaaggaagtgtgtacagcataccttgtaaggaccctcttgactcgagtggtgacgggaggagtatgtatttgcaatatttcgagactggtcggtactgaatccccttatcagcgctgttttttactgtttttgtgccatttcacccatttcacccatctgccagaaactaatacgcttccgataatgcacctagtgcgtcgataatgcaagatacgacatacaccaaaaaaactgggaatggtgcatctgaaggttatgacatgtgttaccctccctttactatcctacgtcatgtatgtatccacagaatgtacagtgcagtaatcaaccaatagtgttcttagacatggagatatccgagtttcctaactccatccccatgtcgcagtggactagtattgcgtctgcgcgggcgaaccctgtcagggatcacgccgacgatgccctcattgagaagctcaaacttctcctgctggagaacgagacccacccactcgacacctttgaggaccaaggcaagtttgcggaagaagcgttttggcgccagtgaccctcgatacattgcgtacatccacaacttccgccttgctctctccgactggaaacaactcctgccacggttcattacaaaatgcagcaacttctctgaaacccgctgcttatcaagtacaacgagcctcaccaaggtttgtatgccgatatccggtttgagtgcttttcggccgcttccgacgcctcgcctccccgtgccttggtatcccggacgcttgtaatgcgccctgctacgctgtttcttacttcctggagcttatgcccctggaattgaagaccgctttctgtaccttggccccgcgaacctgggcagaatttgagtgctccgtcctacagcgagataaagaggaaaactatttcttcggccgactgtttcttactgaaggactgtttgcaattgttgattggcaatgtcaaatccgctacgtttcaggtcgaggacgacgctgtggagaaagcccccacaacgatcacggactcctttcaaaggtctcaaaaatgtccgctaaaggctttcaacaagaagcgtcatagcctgtctccgccgggaagcgttgtagacccacaaaccccccgaaagcctgccagacctctgatcaaggacaaccgccaactcctcaagttcctcaccgaatgctttgacaacttggactggagctccaacaccggcagaacgactgcgcctgctgccaataaaggtgagccggaccatccactgccgacgaaaacaatgccgctgttgagaatatcacatgagttaacctccttgtcaaccctaccgagcaggtagcccaactgagtcgcatctttgaagctctgcaacccctcaaagacactgctacccctcaaagacaccgaagtgtatgaccacctcttcgcgggctccaatccgcagccactgccaccttccagaaactgctgctgccgcattcgccgcaacattctacaccaactcctacggctcacatcacgcctgatgatgataaaatccccaggtttcatgtggcagctctcgataaaacgctcaagcacccactggtgacccatatcaaatggattcccgctctggcaaatgcatctttgccacgtgtccccttcgggtcctgttcggtcgtttccgctacgtggcctgcggctacatgggcagctggattgttccagcccagcctcgccatgccacttacttcctggcccagctattgcttgaagctgttggtttccgcctaaatgccatagtctctacctcgtgggataacctgcctccttgttgctgccgcacgtgccgcgggagaatgtcaatcccccaccacagacgacgcggaccactttttcactagctggcgtatcccgagtaaagacgctggtgctggcgacctccgtggtgctctggagattctggcccgcgacgttcagtacactaagcctgttatctcctcacgagccgtcgccagagccctcaaagtgaccaaccaggcgtacgaacccgagctagctttctgtctacgaggccttttgccgccagcgtgaacccatctaccctttggctcaggaacacgagaatccccgggaacccacgattcctgtcatcactgataactcgcggctccacagccgggactaattctaggcgagagaccagtcctcggtctgacaccaccgcaccaccactgctccttctggtaaccgccgtggttgtttccgtcagaattaggacgcccccaaaccagattctatctggagctgtatgcccatggcagacccttccccgtacgcttctttcagtgacctcgtccaactccatgacggtaaacgtccaaagctcagttcacaagtggcggccacaaacctgccaagttcaaccatggttttactgacaaaaatcaaaaatacaccatgtccactactgtactgtactgtacatcctcgtactgtactcgtactgactaagcaagagaaatggctcctgacgagaaacaaaagatacccctgaggagaaacataaagactgctgagcaaaaagatactccgcaacggagaattgaactccggtcccccgcgtgctgaaacaatgtcctgacaggcggaaattctagccactaaactattgcggaagcggtgggttccgagatgcacagggtgtaaaagagagtggagctgtctttgatttcgggccaaatttaataattatgggctgacactgatatcgatggaacagtgtctttctggagagtacgatggtataattgtattttttccagcacctctgtatcgttttgtatattcagtggagtttaggcacgatgtctggtatactatagcaggagaatacttgcacttgaacagttttttacagtacaagtacttgaatgaggtgctattgcgtctacaataccaactatcaacgacttgaccagcaggtaggtgttgcaagtctgtactgttagccgcagtctgtccagaaggactgttatctcctttcgaatgtctcagaataggtggggtctggtacgtgacgtgcgtctgccaagacgggcgtttggatggacaagcggctatgggttggtgttttaattgctcgagatagtacaaatgttttagtgcggctgatcgtttagtacacagtactgtacatctgtatggcgggtcgtggagtacatgtaagcgaggcttgtacttgtacaaggacagacagcaggttttgtacggtggagggagacttgaacttgtagaatacacattctgattgccattgaacttattgagctgacaacaggcgaaacccacatctctgtggtcctggtcctttgattgttccagccttatacaccatcatcataaatatgcaccattcatatacatacccaaaacaacagacccaatgatgaacgacactgaaaaatcactacaagtactggtacagtaacaaaaaacttgttcaggaagatcttgctttcctacaacaatactacaactacctgcacttttatccaactccggtcctatctcggatcaattgcagaaggatacacggaagtacattgacggtgcatcttggcatcccacctcctcaacagttgagtgggatggggaaggggccagtcacgtggctgctgggccaaccggtgcaaaaaaggggctcttttcgccactctttaaacccgctgtgattggtcaatggcattttcatctctgaaggatcaaaggaacatttttcactgcatccctccttgtagattccaactaagggtacccctcaatgtggctaatgtgaaactttatattttcatgtggcgtagatttgaccagtgttttggtagacccaccaaagtgatacaattgacaggactttcgaacaatgacgattagtaatagtaataccacagtcacgtgacaaacacctgccccaatccgtcttcaaatcgccccaaatcgtcccaaattgctcttttcctccaccctacgagactccagtgactctcccttgggccgatgatccgatgcaccttaatgtcgctcgattgccccacaaatcttaacatgtcgaaaccaaaaatacgacgacacgctagcgcagaaaaaacggctgtcactgtcgaggttaccctagaagagaaatggttgtgcaagtgtccattagtaagcaccatatatcgtgtttctacatgcccacatcggccaatcatgtcgaagcgtccctcttctctacagtatgtacactacaaagtaggttggctcaatgtggggtatccgatgctccgataccgtgcgttctttgctgcgatattccatgcaccccactccatgtcgttcacatagacgtgtaaagtgttgtacaacaccggcaatgggtatataaggcggtggtccagctgttgaaatcgacatcaaccaacatctcttcaccaccaccacaaccaccaccacaacaatgaccaccatccccaagacccagaaagccgtcatcttcgagacctccggcggccccctcatgtacaaggacgtgcctgtgcccgtgcctgccgacgacgagattctggtcaacgtcaagtactccggcgtgtgccacacggacctgcacgcctggaagggcgactggcccctggacaccaagctccccctgattggcggccacgagggcgccggcgtggttgttgccaagggcaagaacgtgaccacctttgagattggcgactacgccggtatcaagtggatcaacaaggcctgctacacctgcgagttctgccaggtggcggccgagcccaactgccccaaggccaccatgtccggatacacccacgacggctctttccagcagtacgccaccgccaacgctgtccaggccgcccacatccccaagaactgtgacctcgcccaggttgcccccattctctgcgccggtatcaccgtctacaaggctctcaagaccgctggcctcaaggctggtgagtgggccgccgtgaccggagctggaggaggcctcggctctctggccgtccagtacgccaaggccatgggctaccgagtgctggccattgacactggcgctgacaaggagaagatgtgcaaggagctcggcgccgaggtcttcatcgactttgccaagtccaaggatctggtcaaggacgtccaggaggccaccaagggcggaccccacgccgtcatcaacgtgtctgtctccgagtttgccgtcaaccagtctgttgagtacgtgcgaaccctgggaaccgttgttctggtcggtctgcccgccggtgccgtctgcaagtcgcccatcttccagcaggttgctcgatctattcagatcaagggctcttacgtcggaaaccgagccgactcccaggaggccattgagttctttgcccgaggactggtcaagtcccccatcattattgttggtctctccgagctcgaatccgtctacaagctcatggaggagggcaagattgccggtcgatacgttctggactgctccaagtaagcgcggctattgacgctgaggagcggccacgactttttggccgtctagtttatgataattatgaatgatgagttaacttgtgtgttgtactgtgtgtacagtacttgtagttgcaatctccagtcagtagtctctgaacacccgtaggacttgtgtgtctgccattccgggcatttgtacttggagtacaagtgcgacttctcgtactcatacttgtatgatgctcaccccatcagctccaagaaaccgattatatcactgcaagaagccgtcagcaaaagtatggtgcgatacttgtagcgcaagacaagggtatcttatagacatcacagtatttcagcattgaaatatcgtataatctcagacgtgggtgaaaggtagcgttttgacgggcaccagaaaactggccaggagaagatcggaacaatttcagtcgacaaacaatgtcatcgccgagacgtcattggtcaaatgtcaactgaataaatgtttcttcactccaaaggagcttcctcatcccttatatgttcaattgaatactactgtacaataccttggaggttgagatatctgctgcacctacgaccttgggggttatcaccttggaggttgtgtgatcttacaagggccaacggggaaaggcccgaatgacacgagacgatctgattcggacggatggagggaggattgcctgtggtacaagccggatcgtgcttagtgacactctctgcgactgtgttgacataatggagtgaggttggggtgagtacaggtacagtgattggggagttttctgaattccagctacctgaatagtttgcaattgatacaagccgatggtacctcagacaaaaatcaactgttggcatggtactgtcaacatgggaactttctaccgctgttctcatgggtgtacacacactcgtcgatggagctgacgggcatgtatcggttcgaacaagtcatggttcgatgatgtcagaagggataccgatacagaggaggaacaatggaaaactcgtgagcgaaaaacagtctcatttggcgtcgttgtttgactaagcagccaaggaaaagtcagccagtgtgtttgaaataatgtcagggtggctacagtacacctgaagtagcagacatgaaggagtccttcagtctgctagtcattcagcccatttacaagatgataatgaagatccctgtgtgttctggcgacttctctgaagacatgcgagactatcaaacatgtcatcggagtgtctctcgccaaatggacatgaactgaggttgttccatcatgaaagtccaattccttagagtacgatcgaggaagttgtttgtcgacttctattaggagactacgagtgcagtagctacatgccagatctatattttgatagagaatctggattcggcttcagaggggactgtgaaactgaagagacaactcagcccgagagagactcttctggctaagacggacttttgccaaagagatgttgaaggtgtttctcagtacagatcctgtcagcattgtaaaattggatgtaattccggtccgaatagaacaacatgtctccaagggtatatagtaaacagagaagaagcaagcaaacagcagagtaaggatacaagaagactcaaaagttgaaaatattcaagtgaatggagtaaatgttactatccaccttattaaagagtcctaacgagtccgtctctcatattgatgtcctcttcatacctactctgttcagacgtaccagtacagcaccagttgatcctaagaaggagtactctgtagaattgccgtttctgtgatgataactgaactgtcgtacgagtatgtacttgaacttgtacttcatatgtctgttgttgtctcactcagcagaaggtcaccgtttacattatgacatacatacctagcttggacgccgtatccaccgctcagagtaacaataaatggagtctgacgaccaaataggatatcaaaagaaccgccctaaactccccaatccaatgatctaattgcttttactcttactctactcatagtcataccacaaccgcaccatctatgtcccacattgctgagaagtgatgacaaagatgaccgactcactgactccagctgatcaaaccccctcaacccccgacatcggtgacgccacgtatatccctcttgaccctactttcccctgtactctcaaagactcaaatttccgttttttcacatgaagtataagtgcaacacatgaatatcgcgtgggacgcgttgccaaactctagtccccccggccctcccttttctaccacacattacaagtctgaaccgccaatgactacgattgtagaggcccaccagacgtacctggccaaatttggcgctcaaccacggtccagagaacaggaatgccggaagaaacaattggccagtacacatgatctctacgacaaggagggatgaccgagtcgattgtctgggagtctctgttccctctcttgaattgggtgcactccatgacatttaggccattttctgaactacgtcatgtgtatcacggcggttattcaggccgggttcatgcggtctttcgtgacattgacccgcgctcaccagatgatgttcattcactacgcaggacaggagaaaaatggccggcttctggcggactgaatgtccgacattttcttctcgtccgtgtccatcattaatcctccttctgctgtcaatgctcgtggcaccggtccctaccctgtccctgccttacccccatccccgacgcttcccaggagcgtatctgcctgcctcctcaaagtgccaacaagtcagttgaacgtgttgatgaacatgttgatgagacagagcacagagacagaagggagaccattgacttgaccagtgctggacctgagccggagcttggggatcaaccaactggaatgtctacccctgacggaacaaggggtctcgacttccaattgagttccgaacccgaaacttacgatcttgatgagataccaggtagagcagaaagcactacaccagctgctgtaaactttccaccgcgtcgttttcaatctcagaccactcaaagaccacctagcgacaaaagccatcgaacggaacgggcaagagaagagaaggtcgaaccattaacgttcccacctcttggacttcccgcagacctttcagctctcacggacaaggtcgccaagctcatttgcaatcctccaaaagaatcccttagagaaacaccatggaaaatctgcagaagaacctggccgtcacatacccaaactacaccaacagatggccagccgatatgcttcccgatgaagagtcgttcttctcgctggaggctactgttctctaccccatgctatacgcccataaacgtcactacccgcttgtgcctcgacacagagacagttcgtacatcctgtattgcaaccgcatgagtcccgatcaggttgatgaagaagatggatcgcatcaaacagtccgaaagaactgcaagtttgcttgaaagtggaacatgataaggaggctgacgaatggcgtctcacacacgtggaaggctgctcggaacacaatcatatgcccaacacacactccagcctgttcctcgaaaacaagcctttggaacctatgctgttggacctaggacggtttgatattaccggaattgttcgaatggtgatatggtcgatgctacgagcgcaggatacagacccacttttagggagtgtgggctgcagtaccatttcatgggtacacccgatgagggtatactcgagctgctcgagactccttatgtgagatatcgccaattccacggaatcacctttttggcgcacatgctcggatacagatggtgaagagcttactctcaactggaaactggggagtaacacttcttgcagctgagacttggttgaaagatgatcaagttgcgggaaaaataagccgactgtagtatgttatatgtctgtgtcgtgtttgtgttgtcagtcgtctcttcgaaaaatgttggcagtgaaacagatggtcacagaagttgaagcgtcatcagttgttgtaacgatacccaggtatttcatggtattccatggtgttgttggatgctgcgtgttgaaccttttgtgtcataaaaacacgatttgcgtcacaactgccaaaaagtcctcagtggcgcctatcgaacggaggaaccataaatactcactcaagccgcccctttcttagccggtgacaaaaagcagccgtctttttcagttttcgagaccaatcacgtactagggcgggttcttggcgatgaaggttcacatgaatagaggattctggagaatctgtaaattgggggtgtatttatatccacaaacagacaattaagctataggtgatatgcgacctcaaactatggcctgattttcccgtgcggatacgtatcaagatttcttatataaaaccgcgaattcgcctccattcaactccagctttgacgatgttcactttttgagttcgaagtagtgcatattaaagttttcatctcattagtccctgcattatcgacgcaacccagaaatacaactcgacgttagtttatcccgaaaggaataagcttcgtgaaaatggcctgattatctgttaaaagtggtctgattatatggcaagtttatggcaccgcaagtttatggcactcccttctttaaggttactcaacaagctgtttttagcttaaatttctcaactgttttcttcaaaactgtgcatatattgacatatctccactagctttcaactaactccgtaaatatttgttcaaaaactttggtacatgctttcatgtttgtatggtatgttgtttgttaagaattaattgggagttttgaagttatttttaatcatttaatattactcaacaaactaccaactttttgttaattaaccttaattaacctttatctgagattctcctcactcgaagaatgggtatcctcaggtgagtcttcggagtcataggaccatcaaacctgtgagacttctccccatgaaataaagttattcaatcgagttattcaatcacgtgatcttcattactccagctcgatgctggcatcaatttgtacttggcctcataagcactttgtgcttatataatccgggtcaacgtatgactggtctttttctgcgcgaactttcaataaaaacttcacttgggtggactgtctcaatcattacaagttcctcctcagcaaaaaatggcgacttagaaccaaagggcccatcaagccagctcagtacatcaattccattcaaagcatctatagcaaaacagtagaaaatacgaggagacttagtgacgacggttgccaataatggaggactcgtatttgctgctgccccccagcctcgtgggggtgccgctgggggagccagcctctcttccaactagctcaagcatgccatggtcagccagaagcctttgggctttctggagcgcttctgctgatggcagctttagaacgaagccagtctgtaatgtgggtgcctcgtagggggtaatggcatcctgctgtgccagtgaaaacacattatagggggtatcttggatccaggacgcagagccgggggtatcaaaaagaccaagggtactgacggagccagggatatcttgtttttcagacagcgaacgtgaaatggtgtcaacagagacgtcgaagcaactgggaccgtcgcaatcatcgtcagaaatgacaatggggtcaagatagcggccaggccgttcgctaggggtatcaaagacgccagagggcggagacgggggggcatctacagcaacggactctggagacgcagcgggcggtcgtttccctaaaggtggactgctccttcgaccattcattcggttgtcctttggagcatcggttgtcttgttcagatactccgcccgttttctacggacacttgcgttgcgctgacgggcatactcgttctccttctggtacgccgggcagttgttctgggcgagctttgcatttgaaaagtgaagcaatctttcaatcccgctgacgacgcgagtccgagccccgtgttcacagctcttgtcaacaatttcgataggacccagccatgcctcccatggaatagcatcaatggactcaagcacgttttcaatggcctgcatgcgaataccctcagcagagggaatatttgcctcaccaacacggtcgatgatatcgagattctgcatgtcttcgacaagagtatcagcctcgttggtctcccagtcgtcaaacactggatcatccacaatctcaaccacccgcggagttgtgtcaggcgtggtctgtgcagcattgccctgtttctcccgttccgtaattcgcttcaatatcgactctgtgggcttcacagtagggtgtccagcgaagacggggcttgaccggaagcagttgtggatgtgatctgcaggcaaggcgaggagagacttattgatgtagttgaacttgtgcagtacagtgactttaccagctgttccgttcaatcgtgaagtcaagttgataaactcgttctgaagctttttcgactcggacttaagtcggcagatcggtccaaggtcgagtggctgcgtgaacggtgtggagttcggaggaagaaaaaacagcttgacgtgtgccatttcgggccatttcttggagagagaccaagctctgtggtgaaacccgacgttgtcgaggatcagagcgatcttgcgattttctcctgcgcctgattcccgcgaaaagatgagcatgtacttgcagaaggtgacggtgtccatccagcccctattttgctgaaagtaccgcatccccatcgtgtttccaggaccagtaaggctaagggcctcatcatcggcaaggacaagcagacgaatcactttggacagctcatcctccgctcttctaatttcccgcttgtgatcatctcgggccttgactgcgttggaaacatcggcttgaagggcctccagccttttatgcttgctttccagcttacttctagcgatattgctttcagtgacaatagcagcacgtctaagctcgtcttgagctatctcgaactcggcaacattgaagctgtcgcttcgaacatcgatggtgtcagctgctggaggaaaatctgccagcttcgcctctagatccttcagctcaccctcaagagcggtaatctcggctcccactttctggatgttcttcttgtagcccttcaatatcttctcctccgcttggaacttcttgttggcgccttgggcaaccacctccagagttgcgacagaaccctccagctctcgaacttttgtcgttctctccttgatgatcggaagcaaaagctcactgctgaacagggtttcccggcccccaggaggctcgaaaatctcttcgccttcgaaaggacacgcaggtttccactgctcgagtttcacagccataagattagcaacctggtcggcgtggcatttcttggctgcattgtagatctcctcggcctcatcggctttagcctccagggtccggtgtcgtgccaacagctccttcttctccgcagaacccctaggtaaatctttgtgggcttcgtgggcctggtctctgagcttgtcgatttcttggtgcttcacaaagagctccaggagacgggcttcctcctccttacactcctctttagctgctgcttccatttcctctacgatatgggccggacgtggtgcagcgttgaaattgaggtagttttggtaggaggaggcccacccagggtagtgtgtcttgccgataatgcacgttgtgatctttcttgacccatccacgttcatgcagaagttcaaggtatacgtggggtctcccttgatacgtccagcgtaaggcccagcagaccaaaccacgctgccgacattgtcaaaattggcgtattggcaggtttggttaacattgaagatgcaatcaggcgggtaattctgcagaccattccagcagaaacccaagttttttacggcatgggtttcgcccaccaagcctcgatcgccatattggctaaggcgtcggtgctgactgtgcaagagtacttttccgatccattcgtggcgtggaaggtccttcatcctgtaaatttcccggtacagaggctgtacctcgagaattcgaaacaagcacttttcagccaccatgctcgcaaactgattgtcgaactgaacgttctcagaacatgtgccaagcacatgaacagtaaactgctccaggtatgggaatctgcagtccttggggctgttgtcgaacgttttggagtttcgtttaatcgcatatccagctgtccggtaggcgcgtttctctaggtgtttgtcgtgttcctcgaccgacctaggagtgttgatctctttggagaaaacgccgagttggtgcaacatttcctcctcggtaatctcttgcttttttactctcttttcaagctggacacgcatatttccgagggcgtcggctttggctctgtcgacatgcattctgccagagattcttacaaattctcttttccgcttttggggcacccgagccagtggacttgttggaaccacatggctgtggagaacctgctgtgccacctcattggagacgaaatagtggggctggtcgggagctcgttcaggcgcttcatggggaccaatatcgctatctgaagcttcaagatcccacatttctgtatcggatgattcatgatgggctgctgctgatgtgggtgtcgctgtcggtatcatcgctaaagccgtgggtatcgccgtaggtatcgcccagccggggccgtttggtgagtgttgggtaccaccgtgaggtgtctcgacacgaggtatcatttcaggcatcaatcaattggctgtgtatctttctgtcgagtgccacgtcgcgactatcgagtagggaggtgtaaacctaagctacgatcacctacagatatatatatatatatacccaccctgccacactctgcatgtaggggcccaaaactatatcctgcacggcagtacatacgaccacagttgtacaggataaaagacagaaacatttacatttaaaatatcatcatctaaatataatgctcaaatgttatagtatataaaaactaaattagtaccgtatctactctctctgtttcattactggcaagtcacagtacgatatcgtttgtactacagtacatactgtactgttggctgtgtagcgtctgttgctacgtctcagaccgttaccccacctggtgacgacgatgatccgaatctccagtgactctagaacttgcactactgtacatccagggttattcaggggtactgtagtcagcagtgttgtactcgcctaacgtctggttactttaatctcttgatgaagagatctgcggttccctttcgattgtaccctacatcttcgtttccatcgtctagtgactctggtgctatagtccatcgagacaataaaacgtctttctctacagtgtacacagtagctacaacatgtactgtattttctgtatcttcctacacctgggcactactggactttcgtgtgccaatctcgctgcttttagtaaaagaaacaataaacgatagactgatatagcggtgtcctccaccaaccctcggccttcaccagttctcccactgttatgtctccacgttctcttcggttgacccttgcataaccctcaacctcgcatacaaagcctgtgtatgtacttgctggaaaggatccacctcaatcaataccacaagggtgtctcttccacaaacgtgatctaacggaatcatccactttcatccccttgtcctgttgccttcattcgtccccatttcatctaatctaaggtacatactgtactgtacaaactgcacctttatctctatcggtacgggcgtacactgtgactcgccatcatatatcccacttgattggggtctctgccagttcccttttctcttcagtcttttgtgatctgccttcacccgctttgtcttccttctagcagctgtcttttgctctagccctctcaatgttgttgttagttagacctgggaaatatgtcctggagactcgcgcagatcactttttaggcctgggattcatatctctgatctctcacataacacactacttgtagttctgtctctttagtccgctgcggatttcagggtcctgaaacagttcacttgtgtagacatcgagtatgtactgtatgtactgtacgagtatcgtctacattgtatgtacaccactatagctgttgcaaatgttctccaagccgatatagactgtttccgggttggaattatgtcaaatatattgaaataggtcaggaggatcaccatggggagtttggtcggatggcgactgttcagctctcgtacaagcgtacagccaaagtagtactttacacgcacaatacttgcactgattggagaagcccagtaaccgtccggatgcttcggtagagtccctggtgcacttttctgagtgtcgataactccaccgttggatttccagtacaagtaaaaagtttcgaggtggaaccatgccctagtctcaaagcaagtaatgtataagtattatataatacattagttgatatatttgttgtagatacattctccaactgagagactctagtacaagtaagtacagtacagtactgacagcatgtactgcttgttgtacttaaccattctgctaaacaatcggactgtgtatacaccccacctcacatgacttcacgtgaccgcactcccgcactccacaccaatcgccgttcacaaccgccattatgatgagtattcaacgggtctcaaactctgttccacggctgcggagctccggcttgctctgaactgtggagcggggcggacaatgagcgtgaagaattacggaccctggaggcacctcgaaatgcatctgatggacactgtggactgtggggggaacaggtgcggggtacactggtgaaattagacttttgatagtgaaaatttgaggggggcgattggggagcgtaatagtcggggttcggaaggatatctgggatatatgacactataatagcgtttcagagggtctcaattgtgaattatcgtttttaaattgtcaaaaacagtcaaaacccgcattttacacacgtatatccccaaacaccgccgaactagatgcggcggtttttttatttaagatttgaaatatgcatggtaaaagtttatattccagctacaaacaccatttaatgatagtgtaatcagaaattgccggcggtgatagctgctgattgagctttggaaacggaaaaaccagagccgaaactggcttattttgaagacacaaaaacgacggggacacaaaaattaccacctcgctaacaaaaaatgagcaaatatggaatctcaaaagaacctgagatgcaccgatttaggtccgcgttgacaatccccttctagagaccctaaccctaactctggggtagatgcatatgccaagactgcgattaagagttggatttttgatgaattttggcgatatttcgggttgtgggaaagggatttggatggttgttatattgatttgtttgagattgttcccattattcgaatttcaagatatttcgcggatattccgtgtcctcgctcttttgggtagagttgcctgtttgggatcgcgttttttatgcatcatctgcatcggaacatgcatatatgcaggtatacgtgtgacgatgtggggcgagttttccagcaaaaaaaagacacatcgacaacgactgaataatcaagaggcgaaaaaaatgacgatatataagatggtcgatcgtcgctgttatttctgcatcatagcatcccagcttctctctacatccccattcccaccatgactccccaccctttcgatcagctctccgttcaggagatggagagcgttgtgcgagtggtcaagtccaaccattcgggcaagtctcttcacctcaagtccattggcaccgaggagcctcccaaggcgctgatggctcctttccttgcagccaagcgggctggcaagaaccccgttcccccccctcgaatcgcacatgtcatctactatgttctggaggacaagttggtgaaccagtgctgggtcgatgttccttccgccaaggttgtcaagtccgaggtgctcaagaagggcatccatcctcccattgatccctgggaggccaacgaggccttcgaggccgcctttgaccatcctctggtcaaggacgccatcaagaagtgcggcgtggagcatctgatcgacaacctcacaattgacggctggatgtacggctgtgacagcgagattgacatgccccggtacctgcagatgctggtctactgccgagatcccaagaccaaccaccaggactccaacatgtacgccttccccgttccgtttgttcctgtctacgacgtgctggagaagaagctcgttcgagtcgactattgcgccaccggtggagacgatgacgacgctgccgtcgagggcgttggcaactacgacacccgacccgagggaaagaactgcatcgagcactgtgtcaccaacgactatcttcccgagcttcaggacaagatgcgaaccgacctcaagccctacaacgtgttgcagcccgagggtccctcttaccacattgacagtgacggctacatcaactggcaaaagtggcacttcaaggtcggattcactccccgagagggtctggtgatccacgatgtccactacgacggccgatccaccttctaccgactgtccatgtccgagatggcggttccctacgccgatccccggccccctctgcaccgaaagatggcgtttgatttcggcgactgtggaggtggaaagtgcgccaacgagctgactctgggctgcgactgtcttggtaccatccgatactttgacggcaacgtgtgcgaccccgagggcaacgtgttcacccgaaagaacgtcatctgtatgcacgagcaggatgacggtatcggctggaagcacactaactaccgaaccgacgtggttgccatcacccgacgacgaattctggttctgcagaccattctgaccgtgggcaactacgagtacatctttgcctggcactttgaccagtctgccggaatccagctggagatccgagccaccggaatcgtctccacccagcttatcgacgccggcaagaagtccaagtttggcaccattgtctctcccggagtcatggccgcctctcaccagcacattttcaacgtgcgaatggaccctgccattgacggccatcagaacacagttgtggtcaacgacaccgttgctctgccctgggacgccaagaacccccatggaatcgcctttgagaacaccaagacccccatcgagaagtcgtgctacctggactcggacatccagaagaaccggtacctcaagatctgcaacgagaacaagatcaaccccatctccggcaaccccgtggggtacaagattggaggtctggccaccgccatgctgtacgctcagcccggctccgtttcgcgaaaccgagccgcctttgccacccaccactactgggtcaccaagtacaaggaccaggagctgtttgccggtggcgtgtggaccaaccagtctgccaacgaggtcggcggagtccaggatgccgttgcccgaaacgagaacgtgcgaaacgacgacgtggttctctggcactcctttggtctcactcaccacccccgagtcgaggacttccccgtcatgccttgcgagattatgaagatccatctgtcgcccaacgatttcttcaccggcaacccttctgttgacgtgcccaagtccaaccagactttcaatcgatccgtcgaggtcaaggactgtcgatcttgcaagatctagtttgtgaatgttttatttaatgtatgaattgattgtttgaatgagaatatagaatgtgatcaacagagacaataagtacagcacgtaacaaaatgattgtttcagagtgataattgaagtggattgagtaccctgcgggatccaatcagtgttgtatctgtactgcgtttgaatcaactaaatattgatactgcaataccgtacttccaactaaatgccagacactatcaattaacgccttgtcgtcctcccgagctctaggtaccactatcttccgatctccgcactatctccaaatctactgagcacctaccccgacctgctgataccccaaccacttgaaaagctgtgggaaaggtagaggagatcttctcgagagaaatcaactaccgttgaacagtcgagagacgagaagactgaggcaggtctggaacaaaagaggttgaaagtgcctcgacagaagcaattgcctgtgatgagaccaaagtcgactgaacggtcaaacatttgaaggagcatggagacgattcaacaagccatattgatgactaaactgaatgctgcgtcggggagacgacggtttgacgaagtccaagcaaagaggttgccaagttcgttgaaaatccaatctgaccagacatgaagtgatatctgactgcctggaacccactagatgttctagtcaggaaaaagccggaaacgaacttgcattcgaaccagttgaatcagttctgggtgcataaccgtgggttaagaagtatagtaacaacttatcttttggtcaattcaccgccagtttgggaatcgaacccgtctctggtctatcaatacgcctagcgcggagaatcgccagaagcatactcgaagttcctggtcagatcttctgcttcaaacagactccagagattgagataagagaccaacatggagacactccggttcagtaacttgtctgaacctgatgtgaggagcgtggaagatatagtcgacaacacagctcctagtcgaagtccgagcctgacgagaaactttctgccatcttcgcagacatgactggagagttacagatggcgggaatcacagccagaagtctcacgtccagattctacagctctggcaaaacatacacagtttggcatagtccatatggctacagagttatctcataggttcccgagtgtctctgaaaacgattgcattatattggtttctttcatgcggacgaatgactacttggattttgaggagatgtacactgtactatacaagaccggttgacaaaacgtctcctccctgacgaactcgtgcggtgggtagtgtgtgtacagcttctcgactagatatggataaccattcgactatcctatcactgatcatccaaccacttatcgtcgccttatgatattcaccaatgctaccgcaatgtacagcatggaggctggatgctccgcctctgctcacgtttactatatacaatgttgtcaatttggtcacttcttggtgtccttggccttctcctcggacttggcgatatcaatggcgttggccgaacactttcgcatcgcttgcagcttgtcgaaacactcggatcgcgagttctggttggctcgcagacagttttcgtacgccttgagatgggagtcgcagtccttgagaatcttgataaaggtgggcacgctggtcttgacgcaggtcgacagcttttcctgctcctcgaaacacttggtcacgtcgccggctcccagacatttgtggtagttgagaaactgctcggggcagtatcgagcgacctgagttagtggtctcttgtgggggttggtcggcggcaaaatagtagtccaaagaccgcagtagcgggtctcccggttcattgatactcacatcctcgacgagggcttgatccagaagcatagacatgtttgttggtggtaggagcggttgatccagattcttaggagagcggttgatctagattcttcgttgctatgcaggctgataaactgaatcagccagcccttacccaaagtcgaaccgagtttattccacggtccaaagagggaaatgagggaaataggggagaaagaggcaggaagagacgcttggcgatcacgtggttggtaccaaatcaactcgcagtagaatatcatcatcaaccacgaatatcatatcccaacatcccgcttgaatcatacatttatcatacatttttacgattacgtaatagagagtgcctccgtgcacaccaccccccagttcaattcccaccaaaacatacttgcctttttttttttttttttttttttttttgttaaagttcccaagtttagtgaacctctgcacctctttgaccatgatcaacgtgctggaaacagtggagtatgtggccaacaaggcggacgacgtcaccgtgaaggtcagtgcgtgcgaatcggccgcaggcgaaattctcgccaacatgaagacccaatcgtactccacaaaaacctggaacgagcccgaactgacccccaaaaccaaagatcgggccaccgtcgactggattttcctcgtggacctgctcaacttctccttctggtcggacacggatctgcaggactcgggcctggcttcttcccagcgttttgccgtcgcctacaacgacaaggagtacacgggatactggagtctgtgtgctgccatcaaccgggccttggacgaaggcatccctatcaccacccccgcatactggaaaagtaacgacttcagtctcgagaaactcgcccacgtattcagatctgccacgaaggaaactgtgccgttgttggagactcgatacgacatcatgaaacaggctggaggggtgttagaagagaacaagttggagtcttttgcccaaattctggaaaacaacaagggaaaatcagccatggagttggtagagactgtggccacgctgttcccatcattcaaagacgaagccacatacaaggacaagaagattcacatttacaagcgtgctcagattctggtggccgatatctgggcgtgtttcgatggagagggatacggcgagtttgtggacattgacagagtgaccatgtttgccgactaccgggttcctcagattctgcacgatctgggctgtctcacatactcggagcagttgtacaagcacattggggatctgaagatgatcgattcgggtgatccaagggaggtggagctcagagcgtgcagtatttgggctgttgagctgattcgtcgggaaatggtgaagcgggaccccaagacggaggtcaatgcgattttgattgacttttttctgtgggacaccgccaaaaagaaccagcagaaggactacaagggtgtttctgtgcagtgtcatcgaacgaggtcgtgttattactagagccggttgcgctccggggtcacacggcagattaatgacggaaagtctcgagatgtccctgacattgagcgcttctttgtcaacaaaatggtcatatctcgatcaccttgtccagcaccactccgtttagcgcacattaggagttggatcacagagtctgaacctcttggtaaccaatcgcaacaccgaattatcatcaccgaattatctcccgtggctttgctgatgcttgtattgtataagtactatctcgagccctgttttatagcaccattggcactaacgcaggttcaaagcgcgagtttcattaaacgcgtcctattgaaaaactcaaaacacgcttgaaaaaaaaaaaccctgagatatagtaagagccacggaagtcggcttaagtaatcgtgagttagaaaagtgtattgaagaaccaaccaggagcgatctaagaagacaagcccattatataatatagatttgagctgtgacgactgatcaggtcacgagggaaggatatgccactgtgtgaagtatggcgtaaatgaggccttcaaggtttcatcaatacaagtacaagtgcatcgtggatggagatgtagctgtcctagagctacgatttttacatgtagggattctacaagcctagagaatcatttttgtaccattttttttttctgaaaagagagaaatcagctgctccaaacctccccaacgtgtcaagtgagacgctactcttgcgctactctcgcgctactctctttttttatgtcttcacacatcaactccaacgagaagtaattaagtacactgtactcctatatattgaagcgtgtcgccctttcaagtctcacacacatacacctcccacataatcccacccaagaaggtgaacacaacacaacgaaaagaccccgccttggcccccgagccccctctgctcgaccagttccacaatgtgcctagacgggagatgctggagtacatgcgctccatcagctcgtgttgcattgacggagtgggcatcttccacctgaccaactgcgaaggaggcatcttctgtcttctgttggtgcggtccgaggccgaaaccaccattttcgacaacgagaatgatgtcgttttcgggggcggtcatgaggtgaagcgattcttcccggtcgactcttccaccctattggtccagttcaaaggcaaccacgacctgctcgtgctcaaatccagcaatggatggaaaagcatcaccgagaagctgcgcaagcagcagtccatgctcaacacctacctaggcttcaacgccgccactcagccccccaacttggaagccttgggaaacgcggacaccaccatcgagtgctcggacgacaagaagatccccgtgcatgcctggatcctggcttcgcgatggcacttcttcaaggccaagctggccaagtcgtcatggacggctccgaagtctgtatccagaccatggtgtcgtacttttatggcggcagagaacagctggatctggaaactgccatcggcttgctggggctggccaagcaacagaagattccgggactggtttccttggcgtcacgatcgatttttgctgccgacttgaacgaccaacagaccatgtcctactggaagcggtcccggaagtacagcgacaccgtggcgtactattgcgccacccgaatgaagtctcccagtgacgacaccagctccacccaagagacctttgagcggttcatgcaggatttgggtctcgtggagggtagattgttcatgcagatgctgtgtcctcaggtggctcccagagcttagatgtcgtgcgttggtccccagcattggcattgttttatttatataattcgagtatatgttttcaaagtgaagtacagtcataccgcagacagggttgacaacatgctagtatcgctcttcacaaccggtgacctgccagaccgttctcgtcctcgggagtacatgtactgaggcatggctaatgggcagcgtagttggtgtggtagtcagcagttgcaaccaggcttctccagactgctggcaacagtttacttactgagcaaagggctttcggtccgaaagagaagggatagttgtgttgatgagcatgagagaggcataacaagcatcaaccagcggcattcggccagagaaacagctcccaagatggtactgacgagcagacaaccgtatcagttgagataatcatacgagacagcgcattgcctcatctgtcgccattttcatgcttcggttgtgttccaaccttggccagcttgtcgaggaactgaattcgggtttcagcttcggtttggccaagcgccagagacatgtgtgaaagaactccgggatggccaatgtacgaggcatacgagtcacgggctacgttggtctgccattcttgttttgtggtatctgggtttcccacgccgaggtaccgggactgtgagagctggaagagctgttgttctcggagtttgtcagcctgtgttagtaaggatgagtgatggaaagtagaggtgatgtattctgtgggcgatgtattccgtgggcgatgtattctgtgggcaatgtattctgtgggagatgcgttcctttacatccgctggcaactgtctggctgaaactgactgaatcaacaagcacgagtgtgatcgtcggattgaaaagggcacatttgcaccgtcacagatcagcccagtaaacagcagccgtattggcctggacacaaacatatctatccacgtttgtaagttcacacgaactggactcaggagtctggagtgagggaagaataccgccaaacatttgtaacgtttgcaacgcaacaacggtctatgaagtgaacacaaagtcactccttagacgggagccacaacgaaactaatcgatagtgtcctgtcagtctcgtttttctaggtctatagcggcggctgaagtccgttcctgttcgtactcaccattgttgtattgttgactgtgtgagtgttgattgagtattagtgaacctgcttgtcgctgtctgtcgcggtgctgtctgtcgcggtgctgtctgtcgcggtattatctttcgcggtattatctttcgcggtattatctttcgcggtgtcggtcgctttcgtggtgttcgtctcgctcgatcgtctttgtcgaaaatagtgtggtttaaattactgcagctgcacactgaaaagctactgctggtgccacgagcctattttgcatttctatcatcacacacactgcaacacccagcatcacacacgactcgggcgcttataatgacggacttggcttcgtctttgcttgcgagcacccaccagtttgtgacccaatcgatcatcgacgactggaacaccagcggccgcgatgaattgtgagtatctacgacggaagacccggggaggggcaggtgatctggacgatatcagtgcaacagagaagcgcgatctgctcccattatcacgtggatcgatggagaccgacattcatcagacgttgttagttgtgttggactcatcggacgttagttggacattcatcagccgtcatcggttatgctgtggttgattgtgtaagttgaaggttgcaacttggatgtgatgaaagaacgggaagaaaactgcgttgacaaaattgcggtcacaaaattgcggtgacaatctgccgtttcatcgaccactaagcaaccacattcgcactgtgtcgtcttagttgcatacctaggttgaagcggtgcggtaatacactcgccaaacgattttgccgattcacccgctcgttcagagaccaactgcaaacattcctccagcccctatcgtccaaccgccactccattccatcttacacatcgccattcatctactaacacagactcgacgtgatccgacgcaacgtcgacggcgacagcatcaccctcgtgaagattctcatagagctcttcggcaacattatcgacggctccctcacccttgatgaacgtctggccagcgtattcgaggaagtgctcaccttgcccttcccaaacgccgaacagacgctgctcatgatgttctccttctttggataccacgagtcgctgtcaaaactccccaagttgctcgaaaacacgatatcgacgtcctcgtggatgctctatgtcaacgacggcaacctgttgacccaaatcggcatagtttcacccatgtttgaaaagaaaattatcagagaacgaaccacaatcttctacagacagcgacgacacaacctgcttcgagaggagacagagggatactccaagctgatggtggagctaagcaatgttgttgcggcatccaaacacattagggacactgccaaactcgccgctgagactgctgcgaacatcgtctcgcttatcggatactttcacctcgatcccatccgtacgctggacatttttctcaacgtgttcattctcgacattacatacacctcggaggtgatgattgaggttctagcacagacgccgttttgggaggaaggtgtccccaactacgaggctgcccagctgttgggtatgaagctggttggagcaaacgccgctcagcatggaaagcagtcggggaacacatgtgctgcggtggcgctgttgatccagcggggcttcatcaagttcgaagccatttatccttttctggagcctctcgaatctcaggtcactgcccagaaggatctctactacgaggagctgagaaacaagccctcggtttcgggaatggcttcgcttggtaatgctctggccatggttcagtttgatggagaaggaggagatactgatgctgtagaagaagaggtggtcacccttgaccctaccattcacacacatcttctgcaagccctcttgacacgtggaatcatggagccctcttttttcatcctttccaagttcccgtggcttcctggtgccttccccttggtgtccagactcatctaccggctgtttgagggcggcttgtcacctctctacgacgcatacagaccgtttgaagaagtgaatgagcttacacaggtcaaaaagcttccctctcagtctaacgactctgttcttacaactccgcgaccccgagtgggtatgtcgcaaccctgtatatatcccttcgacagtgaaggcggagagactcgatttttcgacactaccgacagttggaaagaagctgtggttcccgtcaacaacaaggaagagttgatggatcaatctaagcgactaatcggcttgacaggaccgcatttgtgctacaatcttcgtctgtttgcaaagctgtgcagaatcgctaccgcctgtctatcacaggacccctcctggtggtacgactacctacggctgttcattttaccatctgtagccctcatttccaccaatcctcttgctcttgctgaggtattcaaggtggtgaaacagtttcccgcagatgtgcggttccggctctatggagaatggaactttggcatcctcaaaagctgtcccgagctgcgcattgcaactttgaacacggaaaaagagacgaaacgggtgctgaagcggctgagtaagcagaatgttcgtgagatgatgcgtaagctggcgaaaatcagctacgcgaaccctctgcccacattcacggcttttgtctcacaggttgaatcgtacgacaatctgtctgatcttgtggtcgaagccgctaaatactttacagatcttggatgggacgctctaccgtttgtgatcattctccagctcacatctagtggtcgagatactgtacagaaagacggtctgaacgacagaaagtggttgcagagtctcgcacacttcacgggccggctttgcagtcgatactctgtcatgatggactgctggcccattttcgatctgctcatcaagcagcttcattgccaggattcatcaatgttggttgtgctgagagagattctggtttccatgactggagtagctcagcagcagaacatttcacccgagcaggccctcaatctcggcttttctcctcagctgaagtactcagtcttcaaggtaattggtgatagtcgtctggacaaggagaagccagccaaccgacttttcaacactcttggaggacagcgggcactggagctattcattcttcttgcccagacccagcagaaactcgcattcttacctgacaacagttctgttcatcaaaaggttcttgctctgcgtcacgatgaggtcaccggagtgctgaaccagtacatcgaggctgttacatggttcgtaaagccgctagaaaagtttgcagcgacgtttgcctcggtggttgacctagtcaccaagtacgacgtgtctccagcatatgcgtttgctctgtggcggccaatgttgagccagcagatcaagtccgacccttccgtgcttaaaagtctccgagacggccttccatctcctgaacacatttctccctcgctttatgtgaccttctggcagttgtcactctacgacatttactacgaccacggagtctatgaagctgagcttgctcgtctgagcaagtccaagaagagcagcaatgctggagaactggctgacgaagataagacacacactctgcacaatatgaagaccaagattcgtctttcagccgaaaaagactcttatttcccctgtgaaatggacatcgcatccgacggagccaagattctgcgtaagatgcagatttctgagcttctggcttcctgtgtgcttcctcgagccattctgtcagctgtggatgctttgtactctgctcactttgtcattactcttcatcagcttggaaccctcaacttttcgactttgggcgttctcgaccagatcttcaactcccagctgcttgtcccaacattgtacacgtgcacagctggcgagaccgaaaacctgggcttattctaccacgagattcttgccattctcaactcctggcgtgccaagcccgaggagtacgtggctgagggtctcggaggtctgacgggcacctctggggaggctgctggaacataccgattcccaggcttccgactggcttacggtattggagataacaagaaggaaaacatgctggaccatgacatgctgagaaccgtggtggaaaagtggcaccgaaaaatccacatcactgttgcggagtgcctctcccgagacgactacatgagccgtcgtaacgccatcatcttcttgcggtctgttgtgggcgagttccctcttgtggcgggccatggtgttgatgtgtccaagagattggaaaagattgccaagacagagacacgagaagacatcaagctggctgcgctaagtttgcttggccacgtgacccgaacagaggtgtcgtggatcgaggtctacgatttcaagcccatgaaagaggaggatcgtaaggtcgaaatggccaaggctaataagcgggttatggctcgcaagaaggccattgaggatgccaaggagaaggctgcacttgatgtggagcgccgagagaaggagtcacgtgaatctgccaagcctgaggcgcgtgacgctcaacgtgattcacgtgacctggacaaggcccgtgatgtggagtctcgggtttcctcagctcggtcttctcgtgccacttcccctcgacgagagcgggagcgagaacgggagcgagagcgggagcagcgcaacaaggagcgtatccgtgatcgagagcgggatcctagagattctagagacctgcgtgatccacgtgatggacgtgatagccgggatgcccgagattcacgtgatggacgtgaaagccgagatgggcgtgatgcccgtgagggtcgcgattcccgtgatggtcgcgattcccgtgactctagagactctagagactccagggactcgcgagattcgcgagagtcggaccggaagcgacgtcgaggcaaggaggagcctgcttcgcttcccgccaagcctcctgttcgtcctcgaggcgacggtggtagttcgcgtgacggaagctctcgtgatggtagctccagagaccagcccccacgtgacgttcccgtccgggatgcgcctcggcgatttggagattcggagaacctctccattgaatctcgtatgagcaggcgagcaggtggtggcgagtctgacactgttccgcctcccccacctcctcccagtggtcctcgaagctcacgtgaacgagagcgtgaggcgcgagctcgagagcgagaaagagatgcagcccccggagctattccctctcgaccggctcgggatcgagaacgcgaacgtgatcagcgcaacaaggagcgtgaaaatgaccgtgagcgagaccgacgtcgagccgaggatcccaacaggattcagattgggcgtgctgtgcgagagacgagaggaggagtaagtggaagcggaggaagtgctggtagtggaagtggctcgtccagagatgctgcatctagagacagtgcatccagagatggtccctccagagacggttcttcgcgggacaacggatcttcacgtgaccctgggtctcgagactcctcgtcgagggacaacggctcgtcgtcccgttcgtggaacagagagcctcctcgagaacctcgtcggggttcttccaatggtgatggacggttctcgtctcgaaagcattcgtcatctacccaggacgactctcggggagagaagcgacgtcgaatgggtagatagatggtagaaaatggatagaggtaataatcatttaattgtacttattcgtaattgtatgaaacttttgacaacagtaaaaatacttgtatatttatctgcactaataaaaaaaaaccatgggcaattttttctcaacaaaatagtgttaagattggatgattgttagttaaagacaactcttaggtatcgactagacatttgtgatccaattgatggtatcataatactgtgttatatatatatatatatatcagcagaatacctatagccagtagaattgcccaaagacaatacaatccatcgacatgtaacatatggccaatcctctggcgtcaccctgaagccgtccacctggagtcatatcatagagtgtctggtgtatttgaagattaaatgttcctagaatgaattaacgatcttctaaatcactcttcaaccagcagaatccgatcatggttctcattttgacggttggatttggttcagtattttctgttgcttagtcatcatatctgcagagattccaattgacgtgctatatggacacaagtgctatcattggactgatctcgttcgtttctgttccagtagagtgattcgaccgtatgaacaaatcagctcttgcaaaccggactgcattgttaccacccgtaaaactctcccttttggtccaagtaatatcaacagagtttgttatcattactgcgaaatttgttagcactttgtaaagcaacgagtattctcatagtgtaacgtaccagcctccaactatacctgcagcgtcactgacaccaatcagacgtgaaacttgaagtgaaatcaagcactccggttgtacacatgagttcaccactggtccactaacctccacctttcattgtcacacgactagcgagatcaagaatgtagcatggggttgtccaccgaatgctacgaagacgttctgtactctgtggtcacagcactcggcgtaagagtaagattatgagaagagataaaagaggaagctccatttttgttctccatttttcaccatttttgtcactatccccgtaaatgaggcgtttggcgttgtcgaggagatccgaaaacgaagctctggagcagctcggctccgctcattttcgcgctacgttttttctttgatggccgccttctgggtgtccaatctctgaagaagagctggacgagctgggagagacggcagacggagaaaatgctgcatgttggtattatacgggaacaatgtgcgggcttcacatctgaagctgtcactgagtcgacgtcgagatcgtcagggtacaacctcgaagcagtcgtcgaacctgaagtaatgtatcgatgtgataatgtatagatacaggtaagttggcgaggagcgtactttactatgagaatctagctggtgtaattgactcttcagaagacgtttactagagtcaatcaagtcgtttcgatcaagtcgacactaccccaaactccatctctatgttgcgtcccaccattccgaccagatcttttcgacacatcattgctcctcaattctaactaacaaaatgtacaacattgacttgtatagatctgaaatcttcgacactatttcacttgaaacagaatctgcccgttctttcacttcctcgacttttcctcgatccccttttttttattttatttttatcttttttcttttttttgtcataattatttaaggttaagcgaatacagtaagcgaatgtaagcttcatttttagtgacaagctgttctcaactgcaacaccccggtttcccacaactcagtacatacttgtatgtaggcacgagtactcaagaatatcgcgtttccatagtttagatctcaaaaaagattgcagcacctaggattctcgtatggtctcccactacaatactaactgggctctctggtgcttgactatggctgatcggacgggaagccgtattttcaccaggatatggccgcaaccgtgccctgatggtcgttggagtgtttaaatctgtcggaaacttgctttctggtaaaaaaaactggcacaaaaaccgctccaatccgatagcaatcggtgttatgctctggtgataggtagaagtaaacttatcgtttaccattactagttttggtccctccagggttatttgttgatcttgttgaattctatgggctgtctgatgtcatttccggtattgtactgtacaattatactggatcattgtttgctctctccccctcgctacagctcagcctactgcccacaaagatgacgataacaaacaagactgtccagcttggttacgactcagcaacagaggggtctcctgttcaactctggcaaggtgttgaaaaacaatatctaagctcaatcacctatttcgaaaaagtacaggtttattcattatcactgatcatcaccaaaactggcgttcactttcactaaaaatgaaatttcaggatacgaaaaaaggaaacaccatcgttcttcgagtcaaggccactttcgtcattatttacatcccggacttcgctcacaacaaatgggcccatcatgagactagagaagatagtttctatcagtcgaagcccgtcttggagcagaggcatcttaaagaaaggaaattctctactgctatcaccatttcggtcgcagattcttgggattttactccgagataaggagaaagacctcactatcacgtctgagaattcggaggtgttccagatccacactttcctcttagtatctacggcattcccgagctgctcaaattggtcacccgatacatactgttgatcggcaagaagaacagaaggcatctcactgttggtaaatgccttctggggtggaaacgggcaagtcgtggccattcccacgaacttcagaggccagtttagaattgacaagaccgcagttaccaataccaaactgatgccgatgaaggtcaccatgtaggtgactcgcggaggtggttgactcagacgaagggggttgactgggacgggtgtggttcagttagttggccgaatatgatgatggaggtaggctgaatggagaacttacaatagatccaaatactgtacacaccgtactgtacatacttacttggaggatatcaactacaagtactgtacaaactgtactgtacacaattgagaccaatgatggtgaagcactgagtccgtggaccagaagggacttttacgatgcagttacgaacacttcaaatacttgtccaatctagtggctggatcacctgtttggatcttcctagtgtctgttcagggctaggcaatgtccaggaaatgattgtttgaagacactagacgaacttctcttcgacatgctaaacagatttaattggcttgtgagaagttcacgggcatgcatttggagttgacatctgctcagatccagacatgtccacaaatcatgctgatgctgactcgcaggacgttgagatcacgtgggtataggaggatgagtacgactgaaatcctgaagatacttaggaaacatttcttggtttctacagtgggcatatgaagtgactatattaccagtacagtagtgtaccttttagagaggttcgcaggacattatttgtacaagtacaagtacaagtatcaccatttatggtctcctcaaacacaacttgatttcgtcaacggttccacccaccatttgacatctcatctgcttgatacactcgtcggtgttgcaaactctggtgtatggcgagagtctggaaaagttgtcaaaaaacacctgtcgttgtttcttatcatccacaaacgtcttcacggctctgtgccagaatgtggcgtttaggggagcgtcgtcgggccattcgcgatcgggatcatacgcctttctggccgaatagaggtacttccactcgagtttgggctcagccacgttgtaagtctcattcaagggagaatagtaattgtgtgagtccataatttcgaatgtcttggagtccaccgaatagtatctccaggctggattgtacttgtcgattggagtgattgattggccaatccaggcgacagatacggcatccgcctcggttggggaagacacgttggaagagtcgtagtagactccaaactggtcggcgtgggtgtgtccaaacaggttggctgcaatcacatggggggagaaccgtacaatgatttgtctcagaacctctgttccccaagggacagcgtctgcatctcctcctgtaggtacatgggctactagccagacctttgtgcccgtttcttcggcctgtaaaagctcattggtgagccatctgaaaatcccactggggtccgggttgctaatgttccagtagttgtagtagttttcctcgtaccaaaagttggagtccagcgaaatgacgcgcaagccggactttgtggtcactgcaaaactgccgtacgtgtgtctggcctgctcctcctgctcctcgttgatccacttgtagtctctccacatgcgggagctgaggtctgtattccactcaaactcccgtgcaaagcccgaagagttctgggccatctgggcgtatggatacgaatcgtggttgccaaaggtcgggtaaatgggcaggtctccaagatgcttcttcatctggtagtagcactcatgttcactctgcagcgtcagagacaggctcagaaaccggtctgtatcatgggaaatcatgtcgccggtgaaaactccaaagtcaaacgggacccgagaggcaattgacgacacgtgcgccagcgatttctctagcagaatctgaggcgtgtcacaatggtacgttccaagcttctgcgcaggctcaaccaccttgtccggactgttctggttcacagactcgggaacacaacacatgtatctgttgcaatcggcctctgccccctccatgtatctcaaatcaatgtgaatgtcgctcagatgaagcacgttgaacgtcgtaccttcgcttttcaccccggcggattttggctcctccggtcgagggccccaccaggagctgagatgtggctcgaactgcggcatctcaaactcgcaggcgtcgttgccaaaatgccagcaaatattggttccatcaacgcccctggggtctatcagagacaggacgttagcgatatggcgtcccacggctccccgcgcaagagtgtcgtctctatagacctcacagtcgtctttccagttgtatttttcgcacagtcgaatcagaatcggcggaatcagagccggattaagcttggccagcttgtttccgagtaccagcaagtttttgcaccggctacactcgtcgttagaggcccccagaagcgattccacctgggactcgacccagccgagttgcagctcgttggagagactgggaggccctaaaagagccgactgaaggccaacggtgcccaaaaccacctgtatcagcttgttgagcattgttcttgacacatggatcgtttcgcttcagcccgaaattttatatctagctcatcccccttgcatgaagataacgcacgtggtgcagcaatgcattctagtggaccatactgagacagaacaagtgggtgaagcggtaaagtggaaagtgggtttggggaggttatccgagtctgagtacggtattagcagtttcaccttgcgtccttggatgttcattctttgaccattcacctgttatatccatgggttgaatacagcaatgacagaggacgaggtctgctgaggctctgatataagtatttttatcgattaacagatcaagatgggcacttcaattgagtctgtagagaagagcgaatgacatccatgctcacggatttcctcttgttcctcctctagtcagcatattcgattactcagcagtttttctcatattatcctatcaattgctaaaccattcgaggaatctttgtttgagaatacataagccgaatctcgaacttgtacatgtacttgtttcatgaggtgttctgaagtagaagaggaactcggaactcacttgattcatacagactcttcggttaaccacctcttggtctccactaatgcaatatttgcgctagaaattcaacatgggcgaaaaaatgaatcaagcggccagaagatgtttcattggttctctacagtccacgctgcattcatagagaattcttctacttctaccacaatcttctaccacaatgattccccttgaacacgcctttcagctcagcagttacctctacatcaaagatctggttgctcccgaccagacaagtcgtgaatggaaggctgtggttccagattgcgtctacctgcttgtcatgatacgccattgtccctcatttgtgtcggagaggtctttatgttcctttttgttttcatctgattactcagcaggtttatgatatcacagtacatagttatagttacaacaaaaacaccgcctggctagctcaatcggtagagcgtgagactcttatttaaagcaatctcaaggctgtgggttcaagccccacgtcgggctaattttttgaaaaaagtgacgaccatgtattggcatatcactgtctctgcgcataccacatatcacttacttgtgacggtgagttgttttttactcacgtagacactgggttgtgaccgagaagctttgttatttaaccaatgaacagtgaaaagtgtcgaaatgtcgaacatcgatttccttccatttcacctctggaattaaacctgaaataattaatataaaagtatcatgtaaatgcagcttctacaaagagaaaatagaatgcgcttactgcgccccattgaacattgatccgcgtcaaacagactgcttgttacactagttgccgcttgttagactattgattgtagctcaactattgtagctcaactattaatcaggctctgaaaaacggaacactgcacaagacgggaaatatatcgcatttggcagagcagaattgaatcagacaaaaaaagaaagaatgcccggtaccagggtcgaactggtgatcttcagattatgagactaacgctctaaccaactgagccaaccaggcgttccgatagaggtcagcctgtggttggagccttttacgggtgaaaaacgcaaaataatgcgaatcattagaataaaaaaaaaataaaaaaaaaacctagaataaaaaatattggaataaaaaattggaataaaaaattggaataaagtaaacaaaaacacattataaaaatgtgaatagaatagccatgacgaggaggattgaaaattggacatctctatctcgaatattgtcgaggtttcttttatagtgctatggttatggtgaatagatcagaaaaggttttttttatgatttttttactggaaataggtacgtgccaagttggaccatgaaactaaacgtgtttaattagtaatattcgtgtaagcgtacattcatttcaaaggttattctttcacggcaaagttataattaaatgaatgtatatgcagaaaaaaaaaagatcagtgcaagtgcaagtgcaagtaacccactctggtgaagattgacttgatcaaacttgtagtcggatgacagggaacttctaagactgtcattgtggtatataatatgaccctttggtatgttgttgttgttgttgttgttgttgtcgttgtcgttgtcgctttgtcgttgctttttctcttttctttagttacaattctaaactgtagttggaattacttgacaaaactttacgttttagttaacagaacgcctttaccgtctctctcgtctaccttttccccttttccccaaaatggacagaaaactcgtcaaacgctcctctccgatcctttaaactgcaattgagcacgaccgagacaccttcgctcttctacagactcgtcatcatcctttcatcaccctccgttatatatatatattttctacatataacattagtgcaaacctaccgcccattaaaattcacacgtggagtgaggtgcatggatatgatctaaattatttgtagagaattgcacgtagatcacttctccaacacacaatgtctcttgaggcgattcgatacgacgaaaagaaccacacgctcacgattctggaccagctccggctgccgcatgagtccgagtacgtgcccatcaacaactcggacgacggctggaaggccatcaaagacatggtggtgagaggagcgcccgcaattgcaattgtggcgattctgtcgctggcagtcgagcttgtgcacggaggcaaggtgtcacgggaccagacccgcgccgaggtgggctccttcatttccgaccgtctcgactacctcaacacctcccgtcccaccgccgtcaatctgtcggacgcggtgggctcgttcaaaaagctcgtccagacacaaacgggctcggccagcgagctgattgaggcgttcctgtccgcctcccacaaaatgctgctcgacgacgtgcaggacaacaagaacattggcaagtacggactcgagtggatccagaagaacgtgccccaggccgccaacggacacaaaatcagcgccctgaccatctgcaacacgggctccctcgccaccgccggctacggtaccgctcttggtattattcgagctcttcacgaggcaggagtgctggaacgagtctatgctctcgagacccggccctacaaccagggcagtcgtctcactgcctacgagctcgtccacgacggtatccccgccactctcgtgaccgactccatggctgcggctctgttgcgaaagaacaaggacattggcgtcatcattgttggtgccgaccgagtggtcctcaacggagatactgccaacaagattggaaccttccagctgtcgattctggccaaccactttgaccgaaagttcatcgtggcggctcccaccacctccattgacgttcagaccaagtctggagaagatattgagattgaggagcgacctgccattgagctgacgcaggtcaagggcgtcgatgccaacaagcagcccctcaccgtgtctgtggctgctcctggaatcgaggtctggaaccctgcctttgattacgctccctacaagctcattgatgctattgtcacggagaagggtgttgcagagaagactggcggggagttcaacctcaaggagttcaagtctgccaactagactagtcaatggacggtcttttcataatgatacattttcagtaatgcgcgaagacgctcccgaaccatgatcacactcagtagagagtagctgtcgttgcccaactttccagtccttatgattctacggtcactaatatggcaatacaagtacatgaaaacaccatttctccaagtgtttttctcaaaaagatataacggacttgagggtgatgaaagttgcgagatagtcgttggtcgtggtagatgaatggatataaatagaagggttttacggtcttattggcgattggaagttaatgtatgctgaagtagtgccatatcgtacttcagtcgcggtgcggtcggtaatgtacttgtaagtcgaacgaaataaatagaccgtgctttcagctactgtactgtgagtggtatgtgttgaaaacctgccgggtaaggtctcaaatctgtgttgtttcctagaagagattttgtgcaaatgatatgacatattgaaggactgctggagctttttctctaggtctcagtgatgttagactggcttggtggttgtgttaataactctgtgagttgatattgacggttgatggttgatggttggtggttcaatgggttaatggttcaatgggttaatggttcaatgagttaatggttcaatgagttaatggttcaatgagttaatgggttaacgggttagtgttcaatgggttaattgcggtgtttggaggtcgttaggaagtcccgctaagtcgattcagtttcaatgtctgttgtaagccatatctgttgtaagggattcaggtcccgttctttttatcatcgccagggccagaaaaactgcttgtgacgaagtatccgggtcttcatcttcaacctagcctcgtgggccagatcgtcggcgatatggctacctttggctggcgaatggcgattggcgtaggtgattcggatctttttaggcaggagacggtccttgagaaacatggcctcgtcgaccagcctctgcacctcccgcggaggggagtcaaagtgactaggaagaccgtagccgttggcgagatcgcaggcggtcacactgtcgttgaagatctcgtagttaaggcgaggtcgatgctgcagctttcgaagggccattacaatggccatgagcttggtctcgagggggctttcggcgtggcagggcattccctcattcccggggtcctggtcgtcaaaccaaacaccgatgccactgttgtaatgattacttccttccttgattgactggactccattggtgtagacaggacggtatgagttggcctcgagccggcggaactcgcggagcttttggagcagacgaccggtcaggcactcggtaggattggcggactcggttttggtgattgccagcatctcgttgagaggacaatcttcaaaggcgtgagtgtacagcttcatgtcgcggttgtgaccaattgagacgcaaaggggacaccaatggggattgttcttgatgatgtccgtcacggcttgtttggcatttttgatttgttcgatagtggtgttagacgaaccagtctgttcaagactctgcttaggagcccgttcaggaaccttgcctttgtcgaaaaatgccatgcttccatcactgtcttccgattttcgagaactagactggacactcggcttcttcccttccaacatatcctcattgtggtagacctcatcaagagacggtcgattttcctcgagataatcttcttccttaattttcttcttctgctcctcttcttcttcttccttctttttcttcttcttctcctcctccttctcctcatcctccagagatcgtcgccgctttgcggtggacacttgctgcttgactccgtgtctcccaactccaagatccgacaagttagtagctacagactgcgtgggcttgatcaccttccgtgaggactttgtgtgagcttcgtggatgtagagaccccgcaggatgttcatcagctcgaaaacatcgagggaacgcttctccaggttgtacttcttcttgaaccggggagtcagacacttgatcaaggtggtaaggagacatcggtgaacgtcggaggctcccggatggtctcgaggctgggccaggggctcgggcgactcgtcaatgaactcgaggagcttctcgacggtttcaaattggtcccagaactgcgcctggttcagactctgcaagttctgggctccaaaatagagcacaattcggtcaacgatggatagtctgaacttggccatgacatttagaatgggcaaggttttgtagattcggtccagagagcgtcgcagtaggtcgtaatctgccggatagttgatgttttcttcaggcaggccgatcaggatatactccgagacagctccggcaaattgaaacttgatgaacgacttcatctcgtcaacagaggtaattacgggctcgacagcctcgcaactgagccgaagaagggtcttgcgagcatcgttcaggtctcgaaacgactggatgagccagttctgaaccggtttcactggagactgggtgtcggggaaggtgagaaaccgctcatagataccctgggtgaacggcccgaggtttcttcgggtcagaaggatgtggcaacggtcagagacagtccgaccggtcgtttctttgtatacattttgcatttcggccatcaccagcatctccgccatgagcttgtacagggtgtggattcggtagccgggttctggcaaaactgcgtggatgtttgtctccggagggtcgtggaaaacagagctgtcttctggagcattttcagcgacagaattcattgctgagtagcaggagatgtcagtttggggggttttctgtcgtttttctgtcgtttttctgtcgtttttctgtcgtcttctgtatgttttgggtttccgtgtcgtttttcagatcgttttgggcggcttctgtcgttttggctggtatgtttttcgtgtgtagattgaagaaatgtcgtctccggaggcgagagttcgaatcagatatctccatgtaatagtgtaggtccacactgagtatttgttagacagagtgtattagtagatacgaaaaagtgtaagcgtacatttatttcgaaggctattcttttcaaagcaaagttataatttttgaatgtatatacagaaagaaaaaaaaggaggagtaggaggagggtaccggcctggaccttcataaagcatcggcttagtagactacgtgtcgtcttactaagcaaaaataagatcaagcccctttatagtcgttttgaaacaaagaaagtcgcttatttcggttagacgaatacgaatacggtcttggcgttagattcaaaatatttccgtcccaaaacagagctcaaaaacagcaactaaccgtgtggttgcgtcagtagagcgactgagatgatgtactgagatgatggatacgttctggggcaaacgtggtactatgtcaccaagtaaaagccgtacggtaatgactgtactacgagtaggttgatcgacagcatgtgggaagatatgttgaaggtaatacccggtaggctaatacctggccacttcctcatttaatgatgagaggtcacgtagtgatgagaggaaccagcttggtcgtagacgagatgtccatcctgtagataggatggtattatctttttcaagtgaaagagcaagcacacaccagaagagtttgtgctattatcggaacgtggtatctctggaagtgagttgtaagtcgttacatgaactatacatgaactatatccaatcaacaatacttatgatcttcaagaagatagaatgcagttgcttctctggcgcaatgtgtggttgtagctcggacctttcaatgcgatgacatgattcgagatgagctgataactgagtctacaatgtgacatctggtagtactctagtctgcttatattctgtagatttcaatgcaatgtattacatacgttataaataatgagtctcctattgtacctctgacagtgaggtatcagtcgaagagtagattgagtgtcggactgtgaagaggggatggctgattgtaatgtgacgttagcgtgagtaatttgggtaattcgggtcgagttgagcagatatatcttcagaaagtcgttcatgttgaatctgttgtgaacgcatgaaccagtcgtacttgatcagttggcgcttgaccgtactgtcctttcttagggcgtccgactacatactgttcaaggcataatatggacctggcagggactaatccaaggtgtcgtcgtgatgaagccagaccaaaaagaactaaaaagaactctcctgtgaacacaggtttgtggacgcctcaaaacttctcttactcaatacaattaccacaactcattggttcttcagtcattgctcctctcgtccaactcgcctaggaatgttccctcagatagaacacttctcgtcacgaatgtgcaccatacacaccattctatcacctatatcgatctacaaaaaaaactcgggtaccgtgccaatgttcatttctacacacctatcactggaatgtatagaggagcctcttaagggcccaacatacatacctttgataggttttgtagacgtttacgctgtcagtacagtacatacgtaccaacaagtcgccttggaagcatttttggcggaatgactggctccaaaggaacatccaacctatccagagagatgggatgagcaaccattcagccaaaaataccaccaagacgacgactcagttagtaattaacccagactctaggcccggaggttccttggcccatcaaatgtcggagagctccattcacacagggatagtcctgtttgaagcagctctttcggcccatgttggcaaggtaatgggcacgttcgtttccagggtccccattgtgtcccagaaccctcagaagaaagattgtcgcgttggatcgctgtttgtactggcgaatcttgtcgacggtagacctgaatcggcagtagttgagacacgagatgttgacgagatcgatggccgtctggcaatcgcagtgaatctcatagattcgtccgtcctggcggtcacaggtgattctatacgcatctacaagggcctgtaattctgcctgctgggaacactggtttcctcctcgaagagaggcagccacgttgtcaggatggttctctccgaaccaaactccgtacccactgtagccttccttgcccgcggtccgttggtataagtgtgcgacccgtcggtgtacaccttgtagatcctttctccaaagacagacagatagctgttatcggaggtgttgtaggtctggaacgcggtgcttcccataaactcttcggcagcttctcgcgactcgaaccggtggacgtcgctgtgtcggttggcgtggttctgagccactctgtagttatcatatatccctggatagttacaatacttgaccatccagagatacatgggataggccggagctggtgaagtgataggaggcacctcctcctcagacgcctgtgttgtgacggtcgaagttggtgaagtgataggagacaccataagagacacctcctccccagacgcccgtgttgtgacggacgtatctgagagtgcttcaggtccagggacagaaggggtgtgggagacgtcaaactcgacaaaagtcacattcagaggcgtcgaggagctgactggggtcacaggactgtctggcgattcagggagtctgagatgtccgattccaaagtgtcaggcaagtctggtggaaccgctgtcatgaaatccatgccaacgaccggtgccataattgtggacagcataatgttgaagtttctgaagcagaaagggtgcattttgtttcctgttgaccctagacagacagctctctagttttataaacatcgatggagtgttaactcggtccctccacgcccacccatcatgctctctggcagccatgttgtagagtttcagacccgtattcagatccagtaacaggctttagactacctctagtatgataccgtaaactagctggtgtctcactgtgtttcagtagcaaacgtcgagtagacgagtgtggatatcgatacaagatccgttttcgaccggtgttttggggtgtttccggacgtggctgtggttatcgcgttacgcccgtttcaggacgcgaccgtcaactgaacccttccgttcacgggaaactttcagacacactagcacggtgacatggccggaaagttcactgagaattcaaaatggggtggaatgcgacttggtgagaagtataatggagtgcgtgcgatacgcactggagccatgacagacacgcacggagtctcgccgcaaacaaagacatatcgccagatagttgcacccattttccatcgactgtatcatctccacggcttggtggttctgcagaatgtacgttatctacgcaagttctcttatccgcctgcatgtcaactctatggtccaatggggagtttcagatgggtatcgtagcggttggagtgagtggatgttgaacgattcgaatgtaaggatttggttgttgaaaacggcgtgtgtcccggaaagggccgtcttgttcatcccatgtggaatcatacttggttgaacatgatactaatcgtttgacagttaccaatgatccctaacccccaattggtggttcaattctggtcccggactccagctgagtctacttgtagattgaccctgtgtctatacgcttgtctgggtttttcttgtggtcgatggtgtggcgtggatgttcagcgttactgtcctgaacattcgaccaaccccagactcggatgtattcattagggaccggagtagtcgttgtgaagattcctagacattagggacagggtagttattgcgcatcttcctagtcatgataagtaatcgttgctggtcttccactggaaccagagaagtcattgccgaatggagaagaggagatcaactaccactgctccattcaggccgtgtttcctcgtcgctcagcagcttccagctttgtcgctgtcagttgatctcctaccatggatggaagaagcaagaccaggacaaccagcggcaaaagcgaaatgtccaacagcgacagactgcagaagggcaggaagccataactcctacatataccagggattgaagcctcctgcgagattcacatggactatatctaaacggggagcgacacaactgccggtaacattctctggaatcattctccaagttatttctccttctggagacatctactactctcccatctacaacaagaacagcagactgtatgtctcttccgactagggacctgcgcaggaggtcaacgccatgagatcccagatttctaccaatgtcagttcgttgacgcccagtccctacaggttgcaactcttggccaaagcgtcatcagctcgggtcagcctatacagagggttggatgattctctcaagccagactcaactagactcaactagactcaactagactccatatctcactcttcagaacaaccacaatgtgttcagacgcggtcaacttcgggttctgtctgagacgttcagcacaatccagctgatggtatctccgcagcattgctgatgagaaagaggaacaccatgactctcgtactttgaattcgggaacaagcagttccttgagatggacattcaagtcgccattcagaccgcctttgtcggtccacggccgattcccattggaaaagtccaggagatgatgtaaacaagtggtttctccgtcaccggagcatctcatactgaacggtttacccgttatatcgccctagctgctcatcatggttatcgagagaacaatacacctctcagctgtagcaatttacgacaacacactggttcttattctcttccgacaatacactggttctcattctcttccgacaatacactggttgtcattctcttccgacaatacactggttgtcattctcttcagacaatacactggttatcattctcttcctgcgacgtacaataccaaatacaaaaccggtgttacaatacacactgaagaacttgcagctaccgctctcttcattaccccctccaacccctcaactcccactccattgcaatacatttctaaatacccatgagaagctcgtttttggccttgatttcctttgcctccttttgcattgtcttgagagccagtttcttggcctcggcaaactccacctttttgtatccattcacagtgacgccattcttctcctcgtagtcaatagccgccagatcctcgtccaggttcacctcgcccatgagctccacgttctctcctcgaatgatgtacgtgcctcggtactcctctccgtacaccttttcgggcacggcaaagtacttttcgtaagtgtcctgaagcaccaggttggcaaactggtcgaacgatcgcagaatgccgaaaaacttgcggcctcctcgtagagtcaccaccacttttcctgcgttagttcggtctgtgagtagcgaggtgagatccagtgcttggtggcgtcgcggtgagacagtggttggaattgaatcaaagtaccgcagttcatcccaacaaaccaccgcaacaccccaccaccaaccacccgcaacacatccacgttcaccaaggtatcaactcgactccagcctttcatctgtctatcaaccaagggtaatcactcacgatcaataaccggcagcagagccgcggctgtggtgaaggcctgagatggcaataatccatcttctctggtctccatggcgtttttttgctgttctttgagacgtggtgatagtggtgatctggtcaggaagcatttgggcgcatggtggaggttagggttgggaccaggcctgatgcggatgtggggttagggtatgtataagtaatcatcacccccaaactactaaaagtacgggtactgtactgtactgtactgcactgtactgtactcgtacacctcatcctccatcattaatcattattcattatttcatcaatactaccgttgtagatacctccgttttggctgtgtgtttgtctagttggggaaagcacgagaataaaaggtttcccagacctcaatggcctccttctgggtctcgacggcgttttccaagaaaatctcaatggcgtttcggaagtcatcaaacttttcattctcaaaccgcacatccacctccttcttgatggtgctgctcacgtcgtcaaacttgaccttggcgttgaccagcttcttttcgtactcctgcacctggtccttgagcacgttgagccgctgctgttgggtcttgccctgccgcaacagcttgtcgaggttggccttgcgcttggtcagctcagactcaatgttttgaatcacctggaaatgcttggaccgctgagaaaaagtcgaccgcacagacccaatcacacgcaggtactcatccatagtagagcccagcgttaccatatcctgctggctctgacgggcacaaatctccttgattcgctccacggcgtcactgaactggtacagcacgttggacagatgcttggagatctccacggtgcccagagacgacaaaacagcagccacgtcacccatggactcggccaggtctttgcgctgatgcaccaccagctccagcccgcgcgacatgctcttgagatgcgactccagcacgtccacgtaaccccgcttgtccgagaaccaggggtcggtctcgatgaacgacttggagaaggagaacgacgacgacagggacgacatgagtcccgatccggacccctcctcgatccacgcctcctcctcgctgcttccagcaactccaggtgcactgtgcgagtgcttaatgtcttggttcagctgctcggactgcagaaatagctgcaggtcagggtcgtcctgcagcagatggtggcgggcaaccttttgaagcatagtctccagcgcagctcgtcgggcctccacaaagtcctcgttgaaccgtcccacggcctgcttgtccgggggaggaggcaccacgataccgggatgcttgttttccagcgcatggaacagccaccggaaatcagagtatcggcgggtcaccgatcccgcgtctgtcttaaagttggggtggttggtcttggtcgacaccgtgtacaccgtgtgggaggatgtgatgtcaccgaccttgattgggtcacccacggaaatttcgaaagtgtaggcagccacaggcgcctggttttgggccacggtctcggagtccgcggcgtcagcagcatcggctcctccttcggctcctccggcggcggcagatgcagctccgccctgctccagaggcacgtcatggaactcatgcaggtccgagtcgagtttggacttgaagccggcaacgggcgactctccaatttcggccttgacatgcagaccgcccagctggctctttcgggctgcggacgcgggactggactcggcctcccggtcggtgaccttggtggcgtcgttcaacaacagagggttggtcacatcgtcgtcgtcctccaccaccaagaccgagctggacagcagatttttgcccttgcccttgcccttgccacgtcgcacctgcttgagaatgggcttgcgtttgggagacgacaccgccgcctgatacgccggccggtcgacagacgagtctgccagaaggtcgtggtcaaactcggacgcctggctgggctgcggctcgggcatcgccgcggtcgaatggtcaaacaggtcgtccacggtggttttgtggccgtgcgcatggctgccgcccgtaccgcccgtcgccggcccactctcctcggggccaacgagctcggtcttgtctccatcgatgttgtggatggtcagattggccagatcacgtgacggcgcaggtgccgcgttggtcgacaacgacggggcgtcgtcccaatgagacgccgccagatcctcgtattccgccatctttgtatgttttgtttgtgtcgagtcaaactaccggtacaagtggtggtgatgatgttcagtgtggggacggagtgtagatgtgtagcgaactttaataagtggcaacgtggtgtcaggttgtcagacggagtgtgtgtgtaagatggcgtaggaagggagggttagggggaagaaccgggctgaggggcgaacggccggtggttgagaggttcgacttttcccttacgtaatcatttattcccattggtcgaaagatgtgactgtctttactgggttgtaattagtatcccgcaatggacactctgttaatcttggcgaggttttttttttcttttttttttttcaaaaattgcaaaaatatgagggttttttatagcaaaatccgactacaagtgcggcaccaacagtcgaaaggggtacttttcgacactagtgataatgaataatcgtcagttatcagtgatggagcaattttaatggagtactgtacttgtacgagttcctgaggtgtctctgaacctacagtacagtgcgatatattacttgacttgatagggttatttagttggagtttgttgaccttggagagggtgagcaaaggacgttggaggtgataaggacgttggaggtgataatggaaggtgaaattgtctcagtggcgcctggacttgtatttgatcaattctagactgtttttcggctcaattacagtgtcaatatccctgatattcggctggatataacactctgatttagacagtgtatttgagacttcttgggctggcttgacagtctcaggagagatgatgacacggcaaggcgagaggagtaaaagagtattgtacttgtatttgtacaagaacgtgttctaatagtaagactacttgtactcacattcgtcaacttgttttgatccatctgccatgagtcactgttatatctagaagtaggtacagtaagtatagtgtatatactattatgccatactgtatatactgacaaccattcaccatacgacttcctcctggattaatgattgcaaagaaacgatggcaatcaactacaagttcgactgatttccttcatttccttcatttccttcatgtccttcaatttcaccggttccatgttttcccgaattctttatttcatttttcatttttcatttttcaaatcctgccaatttatcaatcaaatctttaaaaagtcaatcaaccaactcagataatgcaaggttgctgaaatgaaaccacaacaacacacactccaatttgtccaataagaaccagaaacggctgaaattcgaaacatgatctcctcccaactgtatcaccttcctgtccaaaaatcagcccgttccgccgaccccctcctcggaaaaaaccccatccaagttccgtctcaggtttacactcggaaaattaactctcccgtcgactcacggttcgattcgcggttcgacttccgattccacctgttttaatactcgcaaactgagccgggcagcgacacgtgtttcttccgacaacagaatctgctctcgccaaaggtgcatgcaaaaaccgcgctactatcaccgcttcgatttcccgcatccacactaaaaaccgctcaggcctgcaaacttagtgtagtcgaaccacccgcctttaggacatgaagtggagcgttttgagcgtgctgggctcgtgtgtgctggtatcggcctcgttggagctcgatatccggccggtcgagccggcggaagccgacagaatctccctgcaaagacgcaccgttgtgggggtccaggtggaccgtcagcaagcctactacgaggcgcaaatcgccctgggaagcccgccgcagaacctcaccgtgctgctggacacgggctcgtccgacctgtgggtgctcagcaagaacgtgtcctgtttgcccaagggataccacgcagcagactcgtggaagggagtcaactgttccaacggaggaatgtttgactccgccgcctcgtcttcgttcaggctcaacgcgtcggcaaacgccggctaccagcctggaaacaagaaaacgtggccgtttcagattgcctacggcgactcctcggcggcaaacggcctgtgggcctcagacacgatctccatcggcggccagagcgtcgcggagtttgattttggattcgcccagaacgcgagctcgggtctggctgttctggggatcggaccggccggaaatgaggcctcgacagacgacactccgccctggacgtaccagaacctgccacacaagctcaagagcgccggaatcacctcgtctacggcctactcgctgtggctgaacaatcagcactcgaccaagggctcaatcatgtttggaggctacgaccgggcgaaaatccagggcggaaagctcttcactctgccgctggtgcccacagtcgacaaggagagcgtcaccgagtttgctgtgcagctggaggcggtaagagtagacggaaagaactacggagaacgaagcaatgtggttctggactcgggaaccaccatgaccattctacccaaggaacagattgaccccatcatccaactgaccggagcaaactactcacaggaggtcagcagctacattttcaactgctcggacagcccgacctcgggcaccgtcgatttcgtctttatggacaagtctgccatcaccgtgcagctcaccgatctcatctccgtgctcagctactcggacggctcgccagacacgtatgttgacggtacgctggtgtgtgtggtcaatgtgcaggtggcgggaaagaagcagcccagcattctaggcgcgtcgtttctgcggtccgcctatgttgtctacgacattgacaacgagcagatctctctgggcaacgccaagttcaacgtgaccgactcggacgttgttgatctgggtcctatgggtctgggcaacacgtctcgaacccgggaacacaagtccgaggctgccaaggtcccttacggcagctggtggatggcagcgactctacttctttttgcatttttgtagataaacagataatgaataacgactaggatatgctaggagtggtcggagaacgagcagcactctcaatcgtatacagggggtaccatgtaaacggactacaacatagcagggcttcagtacttcagtcttcaagttcccaactcatctgcatttctcatgatactctcagattagcaccaccagtcactccgtccatataggccctcttttacccagagggtccactcaaaagacgaaatgaagtgctcaatgcattcaccgaaacgctgcgagtattttgataccagtatcaacctcatttaccgctgggaaggtgtggatatcgacctctcttgctgcgcggtaaacaatataaagacttgtcgacaaacgtcaacgaaccatttcgaaaaatcacaaaatagagcatctaaaagaaatgaaacggtacctgcttgtatgcaactaatggagggtccatgtgcttagtttcgctctaaattagatagctttctatgcacaattgtgtcattccttggacccacaatattggatctaatcgtgacaaagaaagcttggttttggacaaagatgttcgttgaaccagtgtatcagtatgagtagtacatggtgacaacttcaacggtctgatctcgggagagaagatctactcactaattgtattgtagcaggaagaagcaagttgactggttggccagaaccaccccttccaacgatcaattcttcgagtaggagtacggagtaaggagcacaataccgatctccgccggcctcaactgtccaccgggctcctctgatggtccctcttaagcaccatcatgcatcaggtccattgtgcatagtgcttcagcagggtgcatgtctcagttctgaatgggcgacgaaatgggaagagagtccgagaccaacagaccgatatttgacagtaacgagttcacgactctcttgaatcgaccgttttctggctgtgaacttgacgactgttcaggaagatgataccactcaggaagaaccagtgtggtagacattactcggagctgctttcagactaactcaacgaaagcgcgctgtcagaagcggcattcctgtcgtacagtacgatacctgtatcagagagtgttggtactggtagtagccacttaccttcagcgtcatttcaccagggcagggaacgagcggtgctactaagaagacaggagaatagtcggagtgtcagagtcggttggagagatggagtcggttggagagatggagtctgtcggagtgttggagtctgtcggagtgatggagtcggtcggagtgttggagtctgtcaaattctgttgtcgtttactcacgtcgattgaggacaatgacggaaccattggcaaggagatcaacaggtccatcactctgccatactgtaacagagcagtatcccgagcgtatcccgagcgtacccagagaaagtcttgaagagcatcctggcaatgaacaccgccattataaatttttgatttctgctttctgctttctgataattcaaaggaaaatcacgaaaatcagaaaaatcagaaatactcacaggactccagccagggaccaagaaattgaaccaggtgggtcagaacacacccaggaagacccttaagaacttcccaccaacactgatcttcaatggaggtcgtttgcaaccgcccataaatcggcaagcgcacggaagaagacaggagagtctccagcggttatgatcatcatgttttcgaagctgtggccaagtgagcctgagtgacgaggtgaataccgagcgaatggcagctgtcgaaagtgttgatactactcgctctgttcattcaaataccgactcagctttgttactggagctgtgagaccgttgatgggctgaagagcagatgagcagatgagcagatgagcggatgagcagatgagcggatgagcggatgagttgatgagcggatgagttgatgagcagacaggcaactaagaagatatccactatggctgcccatttagaaggacagactcgataccattgtcaagagaagaagacggataccaagtgacaccccaaaaggtggtccaagtccaagtgtctgaaagtccaagtggtctgaagtcgcggagtgatgggctaaaagagctgaatccatgacttcggcaagagctgcctgttgatgagatgggctgggctggatagaaaagtcgaaagtgaagcagccaccataaaggctcatttacggcaactaccaaccgagagagtggccaagagcagaaagatgtgttaatattcagacaaaaaacgtggaaattcgccagggaccgcgttttgaacagattaatcaagtccctaactcctccagaaccccactctcttgttgtccaacggatgagttcaattgggtaatttgaaagcatcagcagagagaaacacgactgttgcgggccactttggaaggacaaggtccatacaacgtgagctacactgttgattaatctattggtattcgacggaattaaccggtccaagaacctgactgagctcaccagacagtagagctcaagtgtcgcaactctctcagctgccagggttatcgtttgagcgagtcatgagtcaaggaaacacacctctgagctacagtacaagcccgagtacaaagaaagaccggcatcacaccgagcccactgctacattgagtcataaacagaccggagtggccccagatagagcccacccgtctctaggcttgggttagaccttctttggcgtatcgagcagccgaaagttgtttactccaaccgagagagtttgcttcgagttgaccaccggctgctccaggtggtgtttcagagagtcgagaccctatttgcagccattgctgttgctggagcaaacgcatagcctcacggctccctgtttggttagatttggtcttccgatgctggaaaggtgcttgaacacgagattaacatgtcatgccgggtgtgcattccgcatatatttccaggcgacccagaccatcaaactgatagtcgtttctttttttatccccttccactagacttggtggtacgacgagcaataaaaacgctttcgtggacggctatacgcgtggttacaacagcaccattgcgagcaccgtgcacgtaacggatcgagggcgtatccccccacgcatcagtgctatgataagtatgggtacttgtactggtaagcagccccccacgtctcttcatccacctctcctctcgagcaagactttcatctctctcacacccagagtttgtgcatgccctgcttattatcgctcggctgtctttctttcatatgatgaaggaggcggctgtttgtggtgagatgatgagattaggcagcaagacgggaggtggttggttgtttgtttcgaattgtaacatctccagctggttggtttgctatcgcccatattgtatcataagtatgaaaccagttatcataggaacaagctgttgatagggagatggaaaaaaaatggggtgattatggctgcgagatacgacggtcattgagcggccaaatgcgagcgctgcccaacaatgtagcagggaccaattacgaccgccgctttaacctctcaaatctctcgcttatgcccacatttcctctcaaaccatgtctaacatgtccaagaataggccatctgcaccaaggatcatgttcatgtggatggccggtctccgaagtccctgaccagacagagttgaacaagggccatttccgtccatttggctgtttgtttttttcctttctttcccttcctgtagccgaccgtccactttgcgctttgcggttttggttccattgtggaaatttaaccagccagtaaagcctgttcaacagcagacatacgaaaggtacgtgctgtacgttgggtccgtacaatggacaacaatgggttgaagcagcagcaaaaacaagcacggcaccaacctcaaactcaccgcctgtccccatctgagctatttgcgaccgctccagcctaggcggtgttggactgtgttttgtgtcgattatggggacgaaaaaaaaggcgaatgacggcccaacgggacccgtttgtcgcccgtgtccgtccgcacgcctctgggcgtcttttggggccaaatagcaggctggtgcatgtctcacaccccggatttcgttttcatatggcttttgagaccttccatgtcgcttccatcgtcgttccacgctgcagcctgtcgcaaccgtgcagttcgcaaactcaatgagggctccaaaaatcaggccactttgcaccctgaaccaggtgcacctgaaccaggtgggccaaactctggctacttgtagccgtgtgaatccaaacccccgacgcactgcgggtggtggcaaaagacgcaacttttgacggcggattcgcgtggcgatccagcgaccagcgagtgacctgcgaccggccagcggccggcgacaacagcagcacccacgacgacgtgcctggctaacgccgctctccgcaaccactagtgtcgtctctgacacgctggtgcgtacccgggggtctaaggagccacggtggcgaaagacacaaagacaaggtggtgactttgcgacgggctaatcccggtcatttccagcggtcacccagtcaccgcagtcaccgcagtcaatcacgcgctttgtcaatccaacctctgactacgatcggagaattgaggatcatcatagaggtacccgagatagacactcggatatttgcaattcaaatgctgtgcagggtgtggagactaatcctaaagggtggggggtcatgtggaaggtgtttacaaatggaggcagttggtggtggctggtggactctcgagcttcgagcttcacgtgatctgctgtcagcggggaggtgagtctggagttgagccagttgagccagttgatccaggagttgaaccagttgaacaaaagttgactcttcagaaacaaaaagtgagcccggtccaatactaacgcaaatgcaaacacaaaccaaagtgaaaacagacgcaaaaacaaatcaaaacgacttacaccgaaacgcaaacaatcgacacaaacgaacacaaacaatcgacacaaacgaaatacaaacaatcgacacaaacgcaaacactgacaacggacaatggacgacggccctatatctatggcatcaatggttagtcggtcgaccgacaatttacaaacaaccttgagtttgccgagtctgtttctgcgtcattttacgcttttttttgttctccatgcaaggaaattgaaatgacatttgcctctgaaaaaaaaagaggaaaaagaaaaagagaagaaaaaaaaagaaaaaaaaaagagaaataacaaggaaaaatgggaaaaagacgaaaaaaaagaaaacccactacgtcaacgtcgctcttgtcgaaccggtacgagtacgagtatgtacatttgatgggtacaagacatgcgagtacgagctagacaagtggaattggaaaactgaaacggacaagcggattggctcctcagtggtggcaaccggcagcagctatctcgacaaccctggctctctatcttcagttgcttaaaggtagctggaatgaagatccatgcctaatcggttactttaggcagtttgtcgtgtcgatcagcccgttggaacctgagcgttgccttgtgtttggctttggctttggtcatatgcagagtaaagattggaaatggaggcctggaagtaaaaaacgcaaccgagagacgtttgcgtccgcacaaaccagacaaggttgagatggcattggcaaggggcaagggggggagacgggtggggtacgggtacatacgtcgagggtgcagagaaatgtcatggaagcctggctcgaaatactggcgacttgtcaaaaccaggtcgaatcagcctagtgggatccttagctgaaggagaaactctcgtcgaaccactggacctcaacttacgtggaacgtagaggttggggttattgctccttggttagcgtggtggttgtacctatgatccgccaacttgaaacgcgtttgaaacgagtgagcaaggcaggagttggcgatgagctggggttgttggtgtttgttcggttcaacacaagcgtggtggacagcaaacgtcatgcactgaacgcctccacacttgcacggttgcacttgctcatctctgcaccacttgcacacacagtcaggtacacgcggcgatcagtcgtattgtgttagtgtcgccgtatcacacgaccaattggcctctattccagccacatgttgtcaggttcccgtttcccaaacccttgttttctttggcggtgtcgatcgtccccatccacctcgcctgcttgccctacgtcatccaggacccactataaccgaattagaccttgtcttggttccagtacgagcacgcacagtcagtgcactttaaccattttctttagaacggtgcgagtacagctcgtacatgctacgagtgctgctgcgtacattattccatgggcccccgtttgtttttcctataccttttgcgcttttgctatttatgagacatatgatcttccagccgttgacacaagtaattattggtccgaacatggatccgatgaggctagtgctccaacattcctgctggatggttcttcgtccatcgtcgtctcgcttacctccaccgcccgcacgagaccctgtcttggcggcatgggcaaatgtcaggaaattagtcacaaaccccgacttgtgtccccggcgtcatgtaccacgggaaattagctacttgagccctagccccgactcctgaaggactgcgaagcaccgtttggttcgtatcgagtcgaaagcggctccaagggtcggggatctgcgcaaaggtcgactttacgggccgtccggacttccagagacgacgtctggccaatcgaggcgccaccaggttctctttttccatcagacctccaatcagccaaacaaacaagattaaagtgtcatggcctggcagagtatcccatggacggtggaccaaacaggcaataatacacgtgcgggagtgtgcgttccacagcggttatctacaagtacctgggtacatattggggtacaagctggggtacgtaccggtactgtactcgaacagtacttggactgaccatgtaatgccggactaatgagggcaccggacactaacgcgaaatcgcgctgcagtagactgcaaaacggtcgctaaaacaattagtacaaactatacacgtgttgtatgatagctgcggcgggttgctactgtgcacgtacgggcggattaactagctgtggttctaggagtcgcttatcagtgcttttggcatcgatggtaggatgacggctccccttttcgcttttgcgttggtggatgtcgcgaggctagcgaccgtttttcaaaccagaattggtttttgccgttgtactcagtccgtgacaaaagtgttggtcagcgagccacaggtatggccctttccagaggtaagtagatggtgcaggtttgttgattaatctctttggaccggcaaggttctttcaaactgttattataaacagttacgaaaagttatgaaaaatctggcctgcaaccgttaaacacggaggggaattggagacctcgaagacagaaacattggagtagcagaggcatcggccactcgatcgaagagtcgcctccccacaactgattatcgctgaccacgccaatgtaaccctggagaattatttactgtttcacacagacaaggcaaacttagcccgtggcaaggtctgtttctcgaacactcatgggtttgcttttgctgctcccgagccctactgtgacccccacctgcacaaaccaaaagcaacgatttacgtgtttttaaccatatccgaggttgcggtgttatcggagaagcgtgttgagtaagcgagtatgaaggagtgagtgcgtggtgagtgaggagcgacagtccgttgagcatcaagagtaagtacgaatgggagtacagtacttgtactacatttgcaagagtccgactgagcggctgtcaattgtccgtacaagtacacactgtactacagctgtaatacaagtacgacagtgctcagtccgaggtgatgagtgctaatgacgacagcgtacgagtattattacaaagagtacatacggcacaataccaggcgatttgactaagcctcatttgtacgagtggactaaacgagtgggcggattaaacgagttcgtggatctacaccagagtcagttctagtggatgaatacgagtggactctactggacgagtaagaatggactacaagtaccaaccctgaatacgaatggactacaaatacggaacggttgatagggacagtaccaccaccagtagagccaataccgccaccagtagagctaccgacagtagtgtaaccgccaccacgccacggcacggagtagggcaccaccaatacaagtattgtaatcggacgcgtactctactcgcactctactcgcacgcaccgttcaaactgcactactgttagctcacttatgataagataggttcattagcacaaatgagctgatttcgacaaccacgatctaaccgagccctactttgcacctgggcaaagctcgaaggtaggctcagactcaagctggctcaagctggctctggcacaatccgatgaaacgagcggtttgccgaaaaggaccttttggtccaaacgggccaagcaagcacaaaaccacaccacctttcgattttttaaactcaagcgacagcccagacaaaagtctaaagcttaagcccaaagtcaaaagagcgagaaactcaaaccccgagcctaaaaccaaaagagaagccaaaaaactacaaaaaccctaaacctaaaagagactatgcatccccatgcacgtctagcgaagctctaaaggactaaacactgcaaggttcaaaccttagttgggacacaaagtcaccggagtcgtggatggaaaaccctcgtgtggctgtctggagagcccgatatgctcaaacatatatatgcgacggcgacccggcgagggacgtgcaaagtgtcgaccattgaatcgtctttcgagtgaatgcccatggttctctacagttctcaggcgatgcctcaacagcatcatcagcatcaacaacagcatcaacagccctattactatgacagatatacccagggagttcagcatatgcctttgccgtatcagggacagggtcagatgagtcagcagcagcagcagcagcagcagcaaatgagtcagcaagttcctcctcaacaagtgccttctcaacaggtgcctcatcaactgcctccgcaacatcaaatgagccagcaacaggtgccaccacaacagatgcctccacaacagatacctcctcaacaggttccaccatctcttccgccactgcgaaaacaagaatatatcccccaacccccccagatacctcagagcccggtgacggccacgtcgcatctgctgccgattggaaacacggtggtggactcgctgatgctcattatccaggcccaggagctggaccagcagaagattgctaagggcgagaagctggacgccaacggggacgaaatcgcatcgctgctgccgccggtggggctggtgaacggcggggtgggcaagaagaaggggggaccggacctcaaacacaagtgcgacttcccgggctgcgacaagagcttccaccagaaaacacatctcaacatccacaaacgatcccatactggcgacaagccgtaccaatgtgacgttccgggctgcggcaagcgattcacccagcgtggcaacctgcgcacccacaagcggtcgcacacgggcgaaaagccgtttgtttgcgaacactacaattgcggcaaacagtttgcccagagaggcaactaccgcgcccataaactggtgcacgagaaccaccgaccgtttgtgtgtcgtctggactcgtgcggaaagaccttcacccagctcggaaacctcaaggcccaccaaaacaagttccacgcagacactcttcagctactggcatcacggtttaaatactacagcaaacaaatgcgcgagggcggacccggcatgatcccgcccgaggagctcgacatgatcaagtactttggagagttgtacaagaacgccaaccgcggcatcaagggtcggggaaaagactcagtcaagagtcagatgagtcccgagccgttggggtcggcccatgtgactcctctgtcgactccggcgtccgtttcgcacaccctgcctcctctggagacccccaacaacaattactccatcaccaaggtcaaggactctagtttggcccatcccacccaagcccagcagtaccagcctcgacagcagccgtttccgcccatgcaacagtatcctcagcagcagaatcagcagcagaatttcaacatgttgtatcaggagctggccactatgaatactaactggggacataatcagtagcataatttataattttcaggaagtgcaaggaacagtaaggagcaactaagtggcaaatggtgtgatcgttggatgggatcgttggctgattccaggtcgttgctttttctgggatggtgcacattgaagcagctctgacagcgacagctagcgatctggccagtgatgaccaacgactacgaatacgaacacgaataccaacacgaataccgacacgaatacttgtaagactctcacaaacagtacttgtaagattaggggcggatgatactcgatttcactgcgactcaactcactttcgctgcgactcaatgatcctacggctgtctcctgacaagtgagttcagctcggcaactgagacattggaatgtgggcaaccaggaaaagcctcgaagtgtgtttttattttctacggctacataaacgtgactacaaaagaggaatcgactgttggagtccacatgtcgacatttgcggtcatatcattcgctttcgctatgtacgagggtctgttgggtctgtaggatctgtgggttgatttttgctcaggagatgtcgaaaagatactaaacattgttcgggagttgatcatgaggatctgggcggctttcggtttggttcggaagtttttcggggtcaatgggaccctacaagtagagatactatcgctctttcggactctgtcggactctgtcggactctgtcggactctgtcggactctgtcggactctgtcggactctattgggcctcttttgtggtcttagcaccaggtcaatggactttacagtggaccaaacatgtttgatcacacttgtacttgtactcgtactcgtactatctatcctgccaacttctctcactagccaaacctagtagtcgtattgaaaatcacaataaacaaagggtttgccaattccccttctagacccttctcccctctatatttcccacccagcctctcaacagttctcctgctcctccaacgccctagctccacgctccgcgcgtttttcggatcaataatcgcctcgtatcggccgctctccaatagcagaaaatggcgatcatagttggattccacggagctcagtgaaactctgcggagcgcggggagggcaggagcgggagtagtcgtgggctcacgagaggagcgggaggacagtcgtggctcagcaattgttgcgggcccgttccgtcgtttcggatttgcggttttcgcatcgacaggagatctctcggacttgcagtcgtcagctaagcgacatacgacgatcgtcaatttgggtaaggtgagaagtgcacatcatcaggtacagtacttgtattgtacttgtagaataagtgaaatctccggagaagtcgagtacaggtcttgtgtcgaatcagctattcagagaagcgaaatcaccatcccagagaagcatcccagagaagcattccagatcagcatcccggagaagggaatcgccatcccagagaagaaggatggtttcgtcgtcatttcttttgctcaacgtctccaacgtttccatgttttgttttgtttttgttattttttaattttcatttgttaatttttaattctattttctgttttaattttcaattttcatttattaattgtaattttcattctgctttaattctgaaatcttcctgaattgcctccccaaccagttagccgcaactccacctggttgccacaaacagcccgcaaaagtgagacagtcgacagcatgtgtgcagcacaggcagtacaggcagatcggtcccgcacgtcaagccatttcgccgatcacctcagccagtcgagactttcaggtccacagcccctgtctctaattttacgactaatcctagaagtagctacaagtactttgctatatatttatatatatatatatatatatatatatatcacttttccagaggagatgagaggagatgagtacgagagaagattagtacgagagaaatagcgcacaagcagggctggagaagagaaatctccgaatgatgacatccaaaatcactcaaaactgcttctggtaaatggagcagactctgtcactgtacgactctgtcaaatattatttcaaccaagcggataaccacggaacacaacacaataaaaagaccacacgaggacaaaatggcactttggcggtaccataatgacgagaacggcgcgacaagtgtcccggcggtgcccaaatcggcgtgaaatgtattcgaggaccacgttggaagacttgtagttgaacggggcatttaagatttccaaagtttatttgcactgcaattttccacctcattttttacgatttcacgtgactgccaaaaccaccgcggctaactgcaatggggcctgcgcggctaactgaagttgggcctgcgcaagtcgagaaaagcgggcgaaaaacgccagagaaagtcgtcaggaaagagggactcaggtgacagatccatgtggggggcctgaacaggaatatgcaactttatttgagttaatccaatctttttcagtgaatattgtgggcaaatgagcaaaatggaactttataagtgttcgtttgggagcgagacgaagtggttgtacggcatgtgattgcagttttgtgagatggattgggggcggttgagaaatatgtcaatatcattttagttccatttgaggtgcaaactgttttttctcatttttttctcaattgcatgatttgtcctgtttttttctgttttttttctgatttttctgatttttctgatttttcaattttcaattttcaattttcaatttttctttttaattatgacataatttcatttttggctatttttgtctcattttgacaagcggagctaaaactaaaatctccaccagaaacgtctgcacagcgctccaaccgcgttgcagtacgagtacgtgcgaattcggatatgttgcactcaacagatgacaaaggagggaggaaaggagggtgaactgggcgagcacatgtacgagtacgagtgctgtcagagacgggatcagagaagaccgggacatggagttggagtactgtagtggaccgcgacacaaatcggacaccaacaggacaccaacctggaaacagaccagggacacaaatggcacacaaacggcacacaaactggcacacaactggggatacgacaagtatgtacagcacaaagctccgggaccctggagattacatgctagtctttttccatcacaaccacagtccttcctccatgtccaacgcccctccgctaccccgctcatcaccatacagcactcgtacactactgtcttcatactcacaccctacatttctttttgtgcaacgccttttgccgttatcagattgccgatacccgattcgaaatttgtgggaaaatggattaagcttgttttaggcgtgttgggacaagtttgattttggcattttggcattttgctgcaccctaattaaaagatgcaggcgggacgaacgtgggtctggcatttcggacccactccacggatcgggatagaagcggggggagagggtctggcagaagatcgaaggtgaatgattgacgaacaagatatggttaagatggttaagatgattaagatggttggttggttgtttttttttttttttttttttttttcttttcttttctttttccagaaattctaactatttcattttattttgatcaccaaaacccccaaaacacatcaaatggcgacaaaacatcacagacaagaatacagatccccaccgaaacgtcttaaccgtctttgtttgcacacaaagaccgtcgttttgtttcaggtacgatacaactgcagtatgtatcagcacttgtgcagccatcgattttagtgcagaaacaaccactaatgtacatactgtacatacgcaacagaatccgtgtttgtcatgagatgaaacctttcatgtttcatcacgaggagactttttcggagatgctatctggtgagcaataggtcggaaaagtgtgagtgtgagtgtgagtgtgagtgtgagtgtaagtattcgtacttgtaccttctacactcgtactctacccgtggtacaatctgctgatccgttgagccacttgaacctgcagtttatacactacaaaacccagtctcctctgtctggaagtcatctcaagtgcattgcatggccatcaagtgtcacctattcgacccacattgacagcgacaggacgctacaagtaggaactctgacgggtgtcatcggatccggtgggatttggtgaccgacagatgcactctggctccccttttagtccaatacgatgaaaagtcggagagtttcttccacggctttggcacgtgaaaagaaaatgacagaaatgtgacagaaaggtgacagcttggctacttgtagagagtagttgaggaaaagtcggttaattggttggggaggggtttcaatggttcgatttggttgtgctgggcggatgggtggaggtacgtatagtcagtgatcgtacggtatgtactctcactcgtactacacgaccagatgttattggggtgattgacgagagatctttccgctttgagcagctgtatgaagtgacatattgtgctcatctgctcaagactgtccgggcagacacacatgtcgtggatcatctattgacggctccgcagaaaatgtaggagaggtgtcagaaagccaccaggggatcaaagacgttcagaaacaaacaaaacatgactcgagaacaaaaaatcgaaaaacaaatagtgactcatagtactcggagtatgtactgtatgtactgtatccaacaaagatcatagatcggtcaacactgtcgcccgaaagttgcaccatgtcagatccctcaaagtcccacagacagtttatagccacaaggcctctgaaagagtgctcatatgctattcttccaacagtcgtcactcacattctctttcaattgaccttttaagtcatactccacatctgacaaagctgtgtatgacagtggggagtgagtacctgccgcagttctatcttgctctgaagaaaaacgtcgagctgcaacaagttagatttcgattttcttttagccccttctttcacacgcggggattcatttcccctttagaaaagtagctgctgaatttggtcaacctgatggcgtctcagacgaatcctccactaggatgcggagactctcgtgaggagcctctctggtagagagaagagtctggttatgggaacacctcccggcaagtgatatgtaagtcgtacatgtatttgttaataaaatttcactttatccaacaattccttcttgtatcgtcgtgaagactcgagagattggagacctgatcggatgtgtccagcaacggaatacaaagataaaacaccacaatatatccatgttctttgtgcaaccatcaagctctactagttgagaatctcgcccatagcccgcatcaggtctacttctctggactcagagctgagtggcactgtgggtggactcctctggcactgagctgaggtgtattgagacacggagttcaagagctgtcagtaatcgttttaaggcagcttctcaacttcgcttttcctttttctacaaacctcctctccatttagttggtatgtactgtgtactcgtgtgtactcgtacaactcctcgcacaaccatcacgtcagtatacacccagacgttccagaaaatggtcaaagcaccagactaatgactgttaggacgttgtatcgtccattttccaactcctactctccaaaaattcactctgtatacattattattgacacttttcagggaacgtccctccagaaccacccccccccaaaaaaaaaacacttctaatcgagtcgagaacttctgccatgggttacgcaaatgtccttatatacaatgacgaacagtatgccctcgttccgggcttcattctctacattatgaccacggcttgtatctatagctgcacataaagctctggcaaaaaccacccacaaccatggaataggtcgaacccgagaccatagctactctttatcacgttaatcactcataatcaccccttttctagcccacatccgaaatctggactcctcaatgccccacgggaaggctttgagtacatggtagaacccgggagaacaacaagcctcgtaatttcactacagctcggcccacgacttcaaaactcggttcttcgatctcctcggaacagatatcgatccagaatcagctcattttgcttccactcgccggagccgtacagtctcggcccaatctcggtggacaacccgacatctgcaccgcctctacttggaagcaaaagcacaaagcccgtgattattcccaaaaggaccaaacgggtcggtggcgcaacccggacgaatcttgctccattccaagctcgctaagacattgctcatagcttcaggtatttgcgcgtgcatacgttggttgggggttctggggcgcgcttggatagttcctgtcctgtactaatgaggtcaaaaggagacatggaaacccagagtgtggctacgtggtgtatatcctacaccactcggccttctggaagacccagaaagcatcaaacattgcactcgcactagccagacaaacctcatgatcaaaataaccatacataacctctcggttggggggcacacataccttgacaatcgtgtgatttgaaacaagcaagacccatgttttcttgtttgacccgacgttcgtttcttttggatgccgcctgcttgcttttatcaacgctcaaacgctcgcttcaacaagcaccaacgtcagccgaaaaagcacaaccgccggcggaaaaagcacttctccatttccgatcgactttggggggggggagaagttgtcagggcaaaaaaagaaaacctgggaggtgattggacaagcttgagtattcacggcactgtgaaattccaagcagatcgtccatcgtcgtaaaaagaactgctcttgtagtttgttggttatggcaggagtccgatattttgtttctggcgatcatcaagatgccgagtcgacttgctctcaaagtggcgaacggactgattcgatcaacacaattctcgatgaaccgcatggtcttcgtggggttttgattactcgttttgttcgaccgaatatcgtcggattttttctgacttccactcgattttggaataaatctggaaaaaagggaaattagaaccgaaccgctcctccaagtatcgtcaataatttaatatgtacatgcctttttccaaccaatatgcgacagaacgtcgcccgaacgtcctgacaacgttctcaccctaccatcttaccccatcatctcgtcatctcacctcgtcatctcacctcctccaactgctcgttgaccttttcatagacgacaaaagtgatgcaggtggctggcagaacgcgaagcaaattcggcactagacctcgatagaaggcaaagaagccgccattgctgtatatcttgctgatacagtcaccaatggaagagtacatctttccggcatcgtatcgttggagcttggaacgcaccacctggtaaggatacagcaaaacagtggacacagccttactcgtggacgacagcaataagtactccttggttgacaaataactgggagccccttcttttgtgagtgaaatgtcgtagctgttggaggggtcgcgcgaccgcgctagcttgacttgttccttggcccagtcatagaatccaaactgaactgcggcctgcaccactccaagcagagacgggatctggcctctccagaagcccttgattccttcctggctgtagatccgtttgactccgtcgagcatggaggagtatgcgtccacatggccggcgtttgtcgagcagattcgcgtcttgagcacccacagcgggttggtcgctatgcttgtggctgttcctgtgatgagagcgttgaaaaagtagccgtggggtccatcaaacaggtgcattttcttgacgatgccgtagagagaaaagtagacgccgtatcccgcggcgtttccgagtaaattgatgcccagaccgcgatacaggcccttgtacaggccccgaaatttccccgcgtagggtccgtccgactgtcgcagcgatctcagcaccgtccccaggtttccgtccagttgcagtcggattttcagcaggtccagcggatgcatgaacacggtggacacggagcccgccaccgttcccgctaccagatctcgcagccagggatccatctgtggggattttgtgtgagacggaattttttgaaacaatgttgcaaggtttgggaacatgcatagggcgagtatatagcttggattagtttgacgaagttttaacaaaatgtcaacaaaatgtcaacaaaatgtcaacaaaggtcaacaaagttcaacaaaagccaacaaaatccaacaaaagccaacaaaatccaacaaaagtcaacaaatggcccaacaaatgagggttatataacggagataacggacattaaaacataaatgaaatcattgccagtatcgtcagtaaatagtgggaaatttatatatatgtttgtcaagacatacgaagatgatgggactccgaggaggacaccagtatacagcttgccatgtaaccgacctacaaaaaccatcacaatctcactttattttcatatatacaaaagtcgacctgattaggcggtggggaagggagagaggagcctgggttagtggttgccaaaagcgtagaatggcgtcggctgaagcaatagttgttatctcgttcctgatggaattattgatggtaaaactgcgctgtggcagatggccctggaacgctttcatagaagcgtcatttcggtgtttcaggctcgactggatggcaaaaatgtcattggatcctgtcgttggatcctgtcgttggatcctgtcgttggatcctgtcgttggatcctctcgttatcgttagatatccggttgttggataatcctgtcatcagtcgtatcaatcagcccaggcaagcatcaggtagatcactcagacaaaacacccaaaacgatcacaaacgatctcaacctgtatcggtcaacagcctcatcctgtcaactcccattctatgcgcgcaacgccgccacatctcgtaatactcacttgacaagaccgggtcggggaagagtctgggcccatcctattgttagtaattgattgagacatacaagtcgtgactggagatcacacactcgagtcagacactagtcagaacactcgtatctgcaccgactgaatactccgattcatactcaccgacatagatgacaaaggggatccatccgtagtggagggcaactcggccaagatcgaggaccttggaaattcgttctcgggactcttcggaaagctggaagatcattgttgtatgtgtggttccgtgtggagttgtgattctgcacctggaggtgtagctctatctgtaacactcgctctggagagttagtcatccgacagggtaactctaatctcccaacaccttattaactctgcgtaactgtaactcttcttgccacgtcgatcttactcaattttcctgctcatcatctgctggattgttgtctatcgtctggctctaatacatttattgtttattgcccaaacaactttcattgcacgtaagtgaattgttttataacagcgttcgccaattgctgcgccatcgtcgtccggctgtcctaccgttaggggtagtgtgtctcacactaccgaggttactagagttgggaaagcgatactgcctcggacacaccacctgggtcttacgactgcagagagaatcggcgttacctctctcacaaagcccttcagtaccgccgcctgtcgggaaccgcgttcaggtggaacaggaccacctcccttgcacttcttggtatatcagtataggctgatgtattcatagtggggtttttcataataaatttactaacggcaggcaacattcactcggcttaaacgcaaaacggaccgtcttgatatcttctgacgcattgaccaccgagaaatagtgttagttaccgggtgagttattgttcttctacacaggcgacgcccatcgtctagagttgatgtactaactcagatttcactacctaccctatccctggtacgcacaaagcactttattttctcacatatctgagggttttgcacgaccgggtaagtcacgtgggagggaggtgatttttttttttttttttttctgcatatacattcatttaattataactttgctgtgaaagaataacctttgaaatgaatgtacgcttacacgaatatgaaaagttaaagttagttagaatgtcaaaagttgactccactattacttactctttttgttggcatgaaagaaagacgggtttcgtctaatgatggcgattacaagctgaaagagagattattctgggggtcagcagttcttttaatttagtaattgattttgtttacttcgattatgattccccatgatgttcggttcaccgaaaaaacataaaaacataatttaaaaaaatgaaaaaaaaaaaattaagaaaaacaaatgaagaaaaaaatgaagaaaaaaatgaagaaaaaaaatcattcgttgatattctaggacattttgggccaataacaatgttaaaccaacccatcggactcggactcggattgggttttacagaagagcgtactcgtacagaagagcgtacttgtagaagtacggctgtcgagctcgcagttacctcttgttcctcctttagatatacaatcttgaacacggcaaaaaatctggtagtcctttcaagctggaccgtcgagggctacagaaagacgaagaagttggaatcgttgtgggtggcttgttggaatgacgtttcttggtgttctagaggaacacatgaattattttttaattctagtcgcaacctttttttttttttttattctaatgattcattacaactatatacctagtaagccggccattagtcatcaaatcccactatcttagtcccaactttccaaaaaataaaaattccagaggacgtggcgtaatggtagcgcattggatttcggttcttctgaacgacgtcctccaaaggctgcgggttcgagtcctgtcgtcctcttttttgtcctggtgtttatcatcgtcagttgttcttctctggaaataagtttcgtttcaatatcctttttttccaatttctttgtaatatatttaatatgtttttagaaaaaaaaaacgggagaaaaaatattaaaggaacaagacatttggcattaagactccgttatttataactgactgtactcgaatgtatactcaatcaacttcaaatactgtacagatactgaccatctattgcgcgcttcaacattgtgtgtattcattcaacgtattcagctgcagtatatatatttgcacaggcgatccattctcttgattttttgaccacattattcataatcacttcaataacagctccatttttatttccgtcctcctcgtcgctttccttcatgttgttttcatccagttcctagttctccattttcgttccacctcactctcccacagttccgttcaggtcgtgtatctatcggtattacacagagtacagttgtgattacaagtatttgcaactcttgaagtccagagatcaaccttttcccggtggactgttcggagggagaagtcggcagtggatacaccattagatggctatttggccaaccactacctttggagacttttttccaagagtaatgatgatgcgaaagaagagtaatgatgaagcgaaagatacctagtactgtacttgtagttgtaccagtacttatagcttgaatgactcggtatcggtacatatatgccgtcgtacatcacttgtgatttcctgaacccctaccaactttgtcattagcactatatctcatcattggcatgatctcgcactttctttcattacaagacgctgttggccaagaattgctcgcgcttgagctttgaagcatttatttgagatctctacattttgatgctcttggttggtcttagatatggatttttctcatcctggtgttctccatgatcatgttccattcaccaggcttcccataggcaacaaactcctgccctggagcgaacgaagtgttataatgctttcgataaaacagtcgtagaagcatcatctcctcaaagcggcgtttatcgtaagatcaaagtggtatatccggaacagagaatcttcagggtgaattattcgagtttgcaccattctagcctctctgccatctcatcttcttgacatataccatgttctatcttttttgcaaggtagtccacgaactccattcaacaagtacaatgtgcaatacaaagacgctaggaagatgatgatttgtttgttatggactccaacttttccgcagctggagaatgaagttgacattgtattgtaccgcacactagctagttattgttctgtgacttgactacaaaatctttaccacattcagtagtgtatgcgacagaagtggttcacgcattttggaaataaaccctagagacacactagccaccctagatatgtacagattttcaagtccttgaggttcctccgacagttttgaccgtttgcggactcgtaagtgcggcactactatcgatcgttgtgcgacggccgtagctcgtgctcatgttgtcccatttaattcacaactaggatatggcctttaaaaagtccaccatacatatatgagccatacaaagtaacaagttttcacaaggaattgctgtcatctgtcatctctatgtacattgcatctagactagagcacaccgccttgagaacccgtaacgcagtgaacaacgctactattcgacaaaaattatgagagaaacattcaattgttggcctaacctttatataacaagttggacaagttggacaagttgtgggactccatggttttttcaagggatctccttttcaagagatcttacgtacatacggtagaaacagagatgtatacggtcacagctcaaggacgaataatggtacgaaagggagcttgtataagcagtaagaatctccgatggtacttcaaaggcatctgtaagacttgcttttatcattaggtgtacgtaaacctctcatgtggaacttttctccaatccgctcacaccgtgttcaaggcgaaaggtatgtgaaactgggtgtatacagaaacaaagggtgaaaaaacaattaagggctttttttgacgttatagggctcactagaatgacggtttagacgaaaatcggaaaaaatgacacaattcagataacacaatcaaaccatttcaatagaacccaggccctagctcagcaggctgatgaatcagccgcgatgactataccgaaggtatggtcactgtcggaagtgtaaaggaagacatattagaatacaagtaatacaggccaagaaaaatcctgcaagttcctgacccctgacaccatgggtcgaggaatcagtccattgcctcacagcgatctcagtaggatctccgttttttgtcctccaatgattcattatagctatatagctagtaagccggtttttttttgattcattacagctatatacctagtaagccgggttattggcgttcattgcgatgagtgatgacgtaatcagacgaccctaactaacgatattgctccatatggtcttcagaaatcggtttcttggtctagttggtcatggcatctgcttaacacgcagaacgtcggcagttcgatcctgccagaaatcactttttgcattttctacgattaattcagtgtgtattcttgcactttagttttttgaaatatatattttacacctgatgacaaaacctaaaaaatgcataaaaataataactaaaaaagttttgcagagattggcaaaaatgacaaccgagagattcgaactctcgcctccgaagagaccaggatattatgttaaggtgtgaccttaacctggcgccttagaccgctcggccaggttgccggtttttgaaacctctgagacggtgacccctgctatccgaaaagtgtgaaaaatttcaaaaagttggcgaattcgaaccgattttcctcgtaaagtcaattccaaatgagttcagaaagcttcagaatcaatccagtttcattttaatcccttttgggcctcattaagacctgtttagaggtgggagcgtgtgagatttttttgtcaagtataaggggctataatggtgacattttgttaggaactttcgatttaaaaccactggcgaacgggaatacttgtggaacagaaacagacaaacagctacagtcctttggtccgcggcatacagtaattcggtttacggtaattcgttgtgcatggcctgctcttcttggatgaattgcgttgagaaatcttttgagcctttacgatataacctggaataccaaagtcgctagtgatacattcgtttccgttcaattgaatatcattattacattacatacatacaaaaataaagtacacgtaacagactgctgcaagtgtgatttttaccaggaaccccttacattcctatcacgattagttcttggagaaccggggatcgttggtcaccttgttgatctcttcggcaatctgctcacccttgaggttgaagtcaccagagacggcgccaaacgaaccggggaccttggaagaaggaccgtcggtgatgtcaagctcattctcaggcttggcgaatcggggatcgtttccaacctttgtcacatcgtcggcaatctgatcagacttgaggttaaaatctccagtagcaggcttaaagtggccaggatcagtgatatccagctcgtgggtaggcttggaagaagaggcgccagaggcaaatcgagggtcgtttccgaccttggtcacatcgtcggcaatctgatcagacttgaggttaaaatctccagtagcaggctgaaagtggccaggatcagtgatatccagctcgtgggtaggcttggaagaagaggcgccagaggcaaatcgagggtcgtttccgaccttggtcacatcgtcggcaatctgatcagacttgaggttaaaatctccagtagcaggctgaaagtggccaggatcagtgatatccagctcgtgggtaggcttggaagaagaggcgccagaggcaaatcgagggtcgtttccgaccttggtcacatcgtcggcaatctgatcagacttgaggttaaaatctccagtagcaggctgaaagtgaccaggatcagtaatatccagctcatgggcaggcttagcagaggaggaagtgccggtaaatcgaggatcatttcccacctttgtcttgtcatcgacaatctggttagccttgaggttgaaatccccagaaacggggttgccggaagcaggagcagaggagccagtaccggaaccatgagcaaatcgaggatcgttgccaaccttggtaacatctcctgcgatctcgttggagtcgagattgaaagcaccagtagccggcttgaaatttccagggtcggtaatatcaagctcgtgagcaggcttggaagagtcaccggcaaatcgggggtccgagccaaccttggttttgtcgtcaacaatctggtttcccttaagattgaagtctccgtcaacagcattaccagaagcaggggctccagagccggaggaaggaccatcaccaatagcaagttcgtgctcaggatggatcacaccagtctcggttttcacgaatcgaggatccttgccgaccttggtaacatcttcagcaatttcgttggagccgaggttgaaagcaccagtagctggcttaaagtggccagggtcagtgatctcgagttcgtgagcgggcttcgaagaggaggtagaagaagcaaatctgggatcagagccaacttgagtcttatcgtcgacaatctggttggccttcaggttgaaatcaccagtcacagggttgccagaaacaggagcaccagtagaagagggaccatcggtgatctccagctcccgggtaggatgagaagagctagaaccatcagcaaaccggggatcagcaccaactttggtcttatcgtcgacaatctgatttgccttgaggttgaaatcaccagaaacagggttaccggaagcaggagcagaagagccagtaccggaaccatgagcaaatcgaggatcgttgccaaccttggtaacatcaccagcaatctcgttagatccaaggttgaatgcaccagtagcaggcttgaagtggccagggtcggtgatctccaactcgtgcgcaggcttggaagaagaagcaccagaagcgaatcgggggtcagatccgaccttggtctcgtcgccaacaatctggttggccttgaggttaaaatcaccggagacggcgttaccagaagcgggagcagaagaggaagtagagggaccatcaccaatagcgagctcgtgggcgggcttaatggtagagctggattctgtgaatcgaggatcatttcctaccctggtaacatcaccagcaatctggttagacttgaggttgaagtctccggacacagggttgccagaagaagcaccagcagaaggaccgtcgccaatggcaagctcgtgcttgggtttgatcacttcgtcagcagcgtgggcaaaccgagggtcgttgccaatctttgtcttatcgtcaacaatctggttagccttcaggttgaaatcaccagaaacagcagaaccggggtccagagttcgagggccgtcctcaatggtgagctcgtgttcgggcttgatctcagagccagcagcatgagcaaatcgggggtcgtttccaaccttggtcacgtctcctgcaatctggttggacttgaggttgaaatctccagaaacagcattgtcagaagaaccttgggtagaagcttgggtagaagacagggggagaccagcagcagacagcttggactgatggggaagggtagggtcgagagaggcgtccttggcgaagttaggggagtagtctggctccttgacctttgtagagtcttccagagtgctcacgtctcggtcagcgtactgcttaagaggcagaccagaggcatcgagtttagacttgtgggggagagtgtcatcaagctgggcgtccttagcaaaagtgttacgggtggtgttgtcggctgcacccttctcagcaacaggagccttctcggcgttcttatggtagtcgggaacaataccgacaccggcctggccggatcgcagcttgctgaccacctcgtcaccaagctttaggttcttggggtggtcagggtgatcctcaccaacgacagctccaagctcgttcttggtgggcagaccagtggctccaaccttggagttggcaccggggacctcaccgagaggctgggcctcagactcggctcgtgcttcggcgagaactcgctcgccagcaaactcgtgacctcctgaagcagcatctcgagcagcagcaaagccgtgagcgggctcgggctgggctccatcctggcctagaccaacagcatcgacaacagatgcgattcctgccttggccttgcctccaaaggtgctggtgtcgtactcgtcgggacggccgtccatgacgctctgctccacatcgggaagagtggtgtctcggaatccacccaagttgggcacctccttggactcgaggtttcctgcaccgtcagcaacgggcgtggtgaacgactgctcctcgttctggtaggcgtcgtcaagcaccttctcctcctttgtctcgtacttgtcctttcgcttggtgagaccggaaaagaagcctcggattccgctaggcttctcctccttctcgagcttctcagcgacatccttgtctctgttcttaaaggcattgaacttgttgccccaggactctcgcttcttgggcgagggtcgagaagtagggttggaggttggaggggtaccaggagcggcaccagtagcaccggtagtagcaccagtagtggcgccggtagtagcaccagtagtggcgccggtagtagcgccggtagtagcgccggtagtagcggcgccagtagcaccagtaggagcggaggccggggcggaggccggggcggaggcaacacctgttgtgggggtggctgaggtagcaccatgggctgctccagagctgatgatcttctcattcttggcatcgctggccaggacgtccgctcgctgcttttgcagagcatcgtgcttgtcaaccaatttgtcgtggaatcggtccttgccaatctggtgcacgttgtgggttcccgaggcgcccgcagcgccggcggcgccgggagtcgagtactggtctctcacgttacctgccagggatctggagggggatttttgtgcgtctatgttagttgggtctggagttgggtctggagttggcgccgtgtcttgtacttaccttgaacggggtggtgaagagcctggtggccagagtgttgagtagcgtgctgaccggtagctccgggggcatgctgtccgacatgagcggcgtgctgagtctggtgctggccggcgtgctgggtctggtgctggccagcacgaggggcatggtgggactgggttggcgactggggctttcgaccgctcttgatttgacggtcaatggcgctgaacttgttctgcaccgattgcgaaacggacgactgtttgggcgaatggctgggcgacgtcctgcttcgctgcttggcctcgtcctcgacaacgtagacggcgtccttggtttcgatccggcttcctgctggcagggccttgccgtgggacgactcgtacgaggcgtaggcggcctggacctcttcggggaccacatcgtgcttgccgtgtttgggcgagctgagggcgtgggccgcggccgaggcggcttgggggggattgtggggtggttgctgtgacataattgtggtggttacttcgagagagaggtaggaagaagagaagggaggagctcggtattatattgtacaggttgctggacatgcatagacgcagcaactaaaagagatgagttaaggcgtggcgtggaccacttgggtcccagggcctgttttcgggtctaaatcgccccaattaaaagcccagagtgttttcagagactacaatttcctcctggagcattttctccggcaaaaaaaggccccaaacaccggctttcactccggccccaaatccccaggtccgctttaaactccacagtagtaggcgcgatagagtgtcttgcgaactcaattgccaaccgtaaaaaagaccaaggttcaagttgggcagctggacggagtggcgtttggggtgaggcggacgagcatctggcggcgactatcgcagaccttccaccgtcttccacgaccttccaccgtgtccaaaaccccccgctcggattgtccatgtgtcccgcatgcttaagcgagtttcattatacaggtcaacatgcaccgtctcggataatatcgccaagtggtgatactgtacatagtcgtactatcaacagtacatacagtaaccatacaaggtctttgttcgccgtataaagccttcccacacttgcttttggggattggcgtggacacgggacgaggaagcagttgcggggtttttattctggaaaattgcggcgatttcagcagctacaaatgtcgtccttttcttggaccaaacccctcgatgcaatgtctaccaccaagacagtcgccatcatgcgtcgacatcgccgctatgcgccttgcagcccgccttcaaaagccaacatggtttgagcatgtgcatcatgtcgtcataatctgcagcggctagtcggaccagcccaaagtgtgacctccgcccttgtggaaatagaccttgcggtccacgatggaatataatggaaccattgcgggaatttgagccaactgggtaggaacgggtcggcgtcaacagcactcaacggcgtcaaccagcgtcttgtcttgtgaaccgtacaatacagcgagccgccgtcttgcaaccagtttggctcattttgacaggcagcaaccttgggctcaatgatcaacaaggcaactccaagatgacccacgatgtttatgtaagcgggagtgagggagggtgagaggtgagagggtgagggtgaatgaggttagcgatgagagcagaagaactcgttgaggactcgttgaagactcgttgaagactcgttgaagactcgttgacgactcgttgaagactcgttgaagactcgttggagactcatggactggaggtttcgtctcgaattggcgtctccctaatttctatccgaatcaaccaaatctcatcaccaattgctcatcaccaactgcgccttggacagacccttacaacaggacacctcctaggatttttgtactacaagtggtgtaaatatgtataccattcgaatcagcttggaacttcgagtcgattgacagtctttataacatctcttgtcttggtaaatcgtgcaaaatcgtggaaaatgatctaccatctacagttaaagacagtcaggacatacagttgtattgtacagcagtcgtgttttaattgttcatatcacaagctactcactcattgctgactcattcatctcttcggaaagatccactggagctccaagaagctctttccacctcgctgcgagttgtgtctgaccgttcgttgggctttcgtttgatcattcgcagattgtgtctctcctccattgaagaaacgtcaatgatccgtaaggaagatcatggacccgacgcatgtccttggccagaaagttgcagtcctgtggatacaattgcctaccatgatgctctcttgacgcttcaggtagctcacgcagcgaatacagcacatgcagactgattctcaccattaggtacggtaaacggaatcaattcaggcatattcattcaatctcaaaacgtaccagtcacggcacttcggaagcactgtggacttcagggggaagactgtagctaccagcaaccacatgtgtcaataccaaccatcggaaaactcttatcgcaaggcgcgtctggtagttttcatcaactgccaagcgcacttcatacgccctaggaatcagtctcgacgggatccttgatggtgcggatgatggtgataacgggaactccctccggtcgtactctgcgcagctggggcgtgacgaggttcttagtggccaattgctcgacgggagcttcagccgtgtcagtgggaacacgatagtcgtccatgtagagccgatcgtgacatctggacgtggctaatgcatctcggtcggtctcaagaagtccaccattcagagcgtaccgagggtctagaagagccatccagaactccttggcagacgccagcagcatcatcgttgaaacggaaacaaacagacggagcttcatggtggatgtttgtgtgtatctggcaggttccgggtgggcgtttcgcgcgcgtttatatagtgacgcacatttcgaaactgactgctcacgcgcagatgatcgtgatacgtaacaacgagagcaatgacgttcgtatgagtatagtacgagtacgagtacgacacttgttgtgatcgtaaatgtatcgtagttctggagcatgtggtaattcgtccttttgaatcactaactgcgaactcaagccttccaagtgaaccacattgctctgtggcgtaacagcttggaactgctggtaaacagcttggaactgctggtgaacagcttggaactgctggtgaacagcttggaactgctgggcgacacagtcagagcatagatgagatacaggctcgtcttctgcgcggtgattacgtctcaatccggcccgttactcctcctgctcgtcctccaaaggcactcgaatgagctgctccggaagaaccggctcccgatagtcctcctcagtatatcttgccagagccgtggaggcgagattgatggcgcgaatcacggctgcccagttgcccattacctccgccaccacatctgtctcttctgcaagacacgacacgtgttgcaccagtccctccaactcatctgcgaggtcggaagaatactgtcgaagctgaaccagctgctgcagctctcttttcttggccgcaattttctcgtccagctcgctgccagcgtgattgagccggttgggcgccagagaaacccgcggtcgtaccatgttgtttgtgttgtgtatacaagtgttgatgttttttttttctggcaaaaaataacgtgtttctgcacgcgttctaggagtattaaagttacttgaacattcaaacaactaatttacttgacacattagttaatacaaaaaaggggacctcaaaaaacatcctaattacgtaaccaaaaaaacaatcaactctttgaagctcacaaatctttgcataattatcaaacacccgtaaatcggaattttcggcgcgatttgtctcgttatattacacctcggcactccgatttccatcgagtcgggcggttggtgtagtggtaacatatctgccttccaaacagttgctagcaggtgccaggggttcaattcccctaccgctcaatctttttgctccccaacagtcctatttcttgtcgcttagtcatctacccttgcaatctgggctgacggtttattcatgtttttgttcatattctctcactgctcaaactgttctcattattcatattcatacaagacatttattacattcaatcatacacaaatttccttctctagtacattccgttgctctgggtgatcatgagccgctgacctccaccaatgatgggggtctcgctctcggcagcagcagcggcagcctccttggcctttcgctcctcgttgtccttctggagcgcatgcagcagagaagagctctcccgggtgacgttgatcttgtagggcatggtgtagtcctccagcttgtgtctccaggcgacctcctccacgacatcctgtcgcagccagtcgtaacaggtgtacagagttgcgacgtagcactccttgttgccggtaccgacaaagtatcgcagcagctcctcacacacgtcctgcttgcccgacacggcagcagtgtcgatagcgtccttccacagtttgtcctgcttggacagagtgatggacttagcaaactttttgttcttcttgtacagatgggcagcaatctgtcggaagaagataaggtcgtgcttctcgagtcgctgggcgagatcgatggcatcgtacttgtcgtaggcgtcagcggcatctcgcagagtcacgtagtcctcctcctcaatcagaatgttgtggtaggcgttgttgacggcagccaggttctgctcaagcacagtcacaaggaaagacttgatcatgggcaagttgtcggacttgtcaaacattcgcacaactcgagacacgtcgattcgggcagcaagcacagacagcaggtcagtaaccagcatgggaacctccttcatgtagaagttaatggccttgtagtagatctccaggttggccaccttgacaataatgtccttgaaggaggagtgctcaaacgcatcagtggatcgctccatgatggccagagcagcgttgtcccactcgtcgtagtggcagtacaggaagacaagctcgggccacaggtgggcagcctcgcaggctcggatcaccttggggatgttgacacgagaccagaagagcttgaggtgctccatcatctggccaggggagtacttggagtacagaatggccagctcggtgaacatacccatgtgggcacgctccagaccgagaccctgctcaaacagagaaatgagctcggtgaagtagccgtggtactcgtactgggtgacgagatcctgcagctcctcggcgtgcacaatcaggttgagaccacagatctgggccagtcggaattccttgttgtcgatacaagcctggttgacctgcttccacaccttgacggaggacgcctttcgagcagagtcgacagctccctggtagtcaccgaggtagacgagcacagcggcgagcttagcccagttggagatggaagagtacagaatcttggaggcggcgtagttcttgtcggcaaacagcttgtctcccacagactccacattggcaacgttgggcgagtcaagcagctgctgcatggctcgcaggttatcagtggcagcgtaagagaagagcagctgagagtcaatggcaggctcccgagaaatgtctcgagacatcttcaggaaatcaatcagctcctcgtccttgccggcatgactggcaatctcgatgacctgggcaaagttggagggatccttggccttgatgtaagacttgatggcatcgccaactcgcagaccatcgatctgagccttaccaagcagagagtacacctcgggggtgtcgaccttctcggcgtagtcggaggctcgatccagagacatgatgtgatcggtcaggacgctcatgacctggccgtgcttgtcgtgcttcttgtggatctcgtaggcctcctcgtacagctcgttgtcgatacagatctgagcaatgtcgtcggcatcgtagtggtccagacgctcgatgtagttgctgactcgagacttgtcggccttgacggcggtcagaatcatcagattctgcaggttggcgttctcgctgaaaggagagggctcgagaatgatcttctcgagcagctcgagcagctcagcggggagatcggcagccatgaaggccttgacggcgatggaaacggcctcaggagagtcggactcgggcacagcagtgccgacaacagcgtcgacaagctgtcgcttgtgctcgtcgccagagagaaccttgttccacagagcctcgtcctgcttggccagcaggtatcgagcctgctgcttgtacatgctgttctcgttggtgatcttgacaagctcgtcgtccagaccgcccttctcgtaacagatgaaagccaggtaggggtctcgcttctcacagtactttccgacaaccagggggttgtactcgttgttctccttgaggaacttttcggggttgttgttgctgtcaatgtaaattttggcaagagcatcaaacagagcggtgtctcgagaaccaccgttgagagtcttctcgaggaagggcagcagcagcttgagcttgtttcgcttttcgacctcctcgacgagctcggacacggggacctggccaacaaccgacatgagcagatccttgatgatggactcgtcacagtcaacgtcgagaagagcaccaatcaccttgggagttcgggcagggttgactcgctgcacgtacacctcaatgaacttgtactgctggttcttgtacaggtagagcaccaggtcgtgcacaaagtcgtacttgtcgcagacaatgatcagaggcagctggtcaggcaggtgggcatccttcatgaggaagttcttcaccttctcggcgttgtagtggttgttctcccgcacaattcgctcgatctcgttggtctggccaatggcagcggcagcagtgatgtacttgaacaccacatcggggtcctcgctcaggtttacaatggactgcaggtagtagtagagaccctcctgggagttgaactcctcaaacaccttgatgaggttgagcgagcccaccagatcagagtacttggtggcaatctgcacaacaacctgcaggttctgtcggatgttgaacttgagcatctccttgagacactccagagtctggtccacggtgagcttgccaaagtaggcaatcagagcatcgggagggaagttctcggagtgcacaacaacacgcttgatgtccttgaggtcgtcgtagttctccagagcccggttcatcagaccagccttctcacacagagaggcaattcgagcacggtcgtagtgggagaacatgtcggagcccagaatggcgtcagcaacctggggagcgttgatcaggttgacctccagaagccgtgtctgcaggttgccctgctcgggaaggttctggttcagcgcatccagcaaaaaggcggtggcggcctgaatgtggttctgagacaggaaaatgtcggtcaccttgttgaggttaagatcctcgcccttctttacaagcgaggtggcgaactcggcacccttgtcggggttaacccgcacaatgttctgaagcaggacaatatagtcgggagtgtatccgaccttctcgcagtagggcacaatgttgtcaaactcaccgagctcggcaaaagcagccacaaccttgagaggcacgttggctcgaacgtagacctgcagagcgagcttgagatcgaactgtcgcacaatgtctccaagctcctcgctggactcgagcttgtcctgctgcagccacttctcaaacagctgctttcggtcctgctgcagcacgggtcgcgccaactcaatagactcgaccttgttcaaagaacccttgtcgagcagagtggagaagtactgcagaatgggcgagatgccgccagggggtgcctgcacgtttttgagcttctggatggtggcaggggttcgcagtcggccaccgggtgaagaagcagccaccttggcggcgttggcgtagtcgccctggttgagcagctgggagaactgctgctcgtacaggtcgtcggcgccggggaggcctccacgagaggcgacagccagagcgacaccggcgttaccaagactgctcagaatgtactggacaactttctgctcgttgagctcgacggaaagcacctgtccctttcggttgatacacaggacacccttcttctggtaacttgcggcggtgaagacggattcgctggagattcggttcatgtagatgcacagaccctgctccaggtcgtagacgtgaacaaaaccgtacttggtcacgacgtagacaacgccgtacttctcggcggcaaagacagccacggggaaatcgttggcggcctcgggggggaagaagatatccacctgcttcttctggtagacgggattctcgtccttgtggtcaatctcgacggcgtgcagcttgcctcggttggcgaagacaaacagatccgatgggctggctccatcctgcagctgcagctttgtgaaggtggcagcgtggccctcaatggcctgcgacacgtttcgctccttgctgtagagctggatctggcctgcaattcggccgtcccgctgggtgatgccgaccagagcactccagctgccgttggagatgtagttgatcacctggcagtcgttgagcgagtggtgtcggtcggtgagcttgacggggtctgtggtgccaaccttccagtgcagaatctcagtctcggtgatgatgccaatggtctcagcgtcaacccaggtccagaacaccacggggacagagagctgactgctgcccagtcgctgcttggtctcgaggttgaaggcctggagggcgccctccttggatcgcacggcaatcacaaagtcggtggggtgcatgattgccgaatcagcggagatgtttcgtcgcacgacattgttgttgttgtggagatcgatgattgccacggtgttgccagtgttggctgtttcccgaacgctgagttagtacatgtaggacatgtaggtgttgagactcgagtgcgacgcgaccgatcccgatcgcgatggactgatccatccaccagtcggacacaatccagacagacagacgaatcaggagaatcgtcatgttgacaccattgttgtaacatcaggatgcatcaccacatgtgttcccctcccccctcccccacaatcgcaaacatgcaccattgcatcctgatgactccacgtccaatttcaatcattgattccatccgtcttgttgattgcgtatcccgtccccgtctgtgaccctcggtcgtctatctgtcacccgcctgtccgtgactgtcgtctatcgcgcctctgactatccaaatcatcaccgctcgccatactcaccaaacaaaacgatcactctgcaaagtacatgtgttgaaaccaatggaggcctcaggaacacccagcgattgaagctggagatgctcctgaaacgtaatgggcaaatcctgtgacatgttgaggatggtggaagaaagaaagagttgggagcacacttgtgtacagttaggcaaccttgatgatgtgtcctaaatggcgcagtacaggagaccgcaaacgcgggttagggaaacggataaacgggggcaagggcagaatgggcccaacccagcctcagtacaacaatccacacgaaatccgcctcgaaatcgctccacaataccgtatgctagccctactgagttgtggttggctggaccacggctcaaggttagggtttgcctggagtttacaggcacacacaacgcacgatgcacaccttgcccaaggggttagggttcagaacgtgtgtgtgtaggtggcaatttcacgaccatcaggatcaatttaacgacatttgatgacatttgaacgacaatttaaccccaatttaacgacaatttaactgagtattttaaaataactattgaattaagtgtaggggtgaaaataaggatgcaatgataaaatgtgtacggaaaatgtacgagagacacaggtttatgacaaaaccacgttacgagaaaacgccgtttttctgacctttgaagctgaaaatggccctttgacactattcgctggcgggtcaaattatctaaacaatctcatgctgccacgttgtgttcattgtcttggcatatgtgcccgcatcttattagcccagtgccgaaaagtggaagtggaaaagtgaaagtggaaagtggaagttgaagcagctccagcagacgcaattgagctgggtaaggacagacaggttttatttatagagcttttggcgttgcaaaccgctatgggttagggcatttgactacgagggctatgagcggctaagtatcccagttgcacttgtacttggcatttttcaccctgaaatttcagaggggctgagtcttgcatcaggtatgtgcagaagtgtctcgggggtagggtgcgagtgcgagtgcgagtgcgagtgcgagtaaagtacgagcgtatgaggtttacttgtaccggtttgttggttgcgaaattgcgtactgtttcttcagatttggtattccagctgtgatctctctgactatttttattatttcagtgaaattgcgttttacggagttaatctggtcggagttaacctcgaaagttgtgatctccgctaaagaggtggaaggaaaaatggggagattagtacgagtatgagtgagtacgagtatgagtgagtacgagtatgagtgagtacgagtggaaaggtgtgggtttgatgcaatcttggatgaaatcgttagaagtacgaatccgctacacttgaaggtattgtactgtacctgaatagtaaggggggagctctagatatgatattgtaccgtttattcgagtattggcactcgtattgctactgtctgataccggtacggttgaaaaaactccagaccaactcgatcttggcaacagacgctactttgtttgatgagaaaagaggtccataagtcgtccccgaaagccgaacactttggaaccaactcagtcaattgggaatattctttgcttcagttgaattccagctcaaattccatctttccactcatacgtagcatccgaatatgaacactttgcacaactgattcgcagattgacgactggtgttcacggaaagtcgacactggcttctaagacaatcagaaagatgcgttccaaactcgttctaccagacctcaaaaacccttgctgctcacttctgtaaattagagctattgattcgagcgctctgttcttcctccagggagtagggtgtccaaccgacgagatagcgtagtcctgaatcgaagcattgcaccacaaacaaaggcaagaacttgggggctttgtagcaaaggccgacttcattcagatgccattgaagccattgtacagggtagtttgtcgtacagacgtaattacgatactgtactccactatatgccattgtagcttgatcagtaatcctcgcttgcaactactggtctctccgatttttaccgaaatcgacaagccctattagactagcctagtagtcgttcaaatcacattggcttgatgaaaggaacgctggactactgtatgtattgtactcttccgtacataccattcaatggccaaccacgcacgtggtaggggattggataaaagagcaggagtgacccggagcaattgtttgttttgcaattgttgttttgcaattgttgatttattgatggttttgcacggagtcatagtagatagctattaacagttggtgccatgcacaaggatgagtgttggtccagaccccagctgtcagcgtattatctgctagagatctgtcgatagattatcacgatcacttatggtttcttttcttgcaacatttctccataattaggcgaactacccatgttgattctgtcttttctctttcttttctattactctgaaaaaggcccaatcacacgcgcgccattgtccgtctcagctgtccctgatcgtcagattattgattgtcaatgtcgttgctaaggaggggactgtaatctatagttcggattcacactactcagcctatggcatggctgctggacactagtgcaacgctacacatgtttttgttttgttttttgttttttatttgcaagtggctgcaatggtctaaaacggcgaaaaagctgctagccatgttggggaaaatgttgtgaaatggccatggattgaacattgattgaataactgttcgttgacttaacaactatcctaagacagaacagcttctcattcgtggtaaatgtctgtcctaagcaacctcgtttccgtatctccacatctccgctctccacaaccccccaagaactcgtatccatcttggcggggactccctgccaagaagaaaatttctgccttgggcttggcctatagatacaaactccagtggagatgccaggagttctggtaagtccagacaaacatacggactaattgtagagacagtgattgattagacaagaatacacgagtcggattccgattgagaaggcttggctattggtactgtacggcccttgggttgattctttgtattaattaggtcattaaatgtttgatcgttattggtggttttcatggttagacagcctggacaaccttctcgttgacctgcttcttgtcgtcggaggatccggcagacttctcctcgaagctgttggtcaccacgagtccagcgtcgccgttctcctcggtggatccctcgttctcgtccatctttcgctgctcggacgcccgcttgattcgctgggccacgttgaggttgatatcggcgttggtgagggccaggcagaacatgatggcacagagaacaaacggtccgaccagcagcgatcgcatgacggtgttaagggaggctccgatggcggctcgctggggtgttccaatcttgtatcctagaccggcgtagatggaactgaaaatggtctggatctccttttcggaaaacaggcccgtctcccgcagaatcttggggaagtggtttcggtagacggcggcggagattacgttgcccagaatggtgccggaggaggtgaagaagtagtagatggtgatggcggcggccgagtcggactgcttgcacaccacctggatgtagaccataacggggatgaccagcagaccagcacccactccctcaaacacctgagccagaatcatggtgctgaggggcttttcaggccgtcggaactcgtaagtcagtcccatgccgatgaagtagagaatggtgccccaggtcagcaccgacttgagcttggctctccatctcatgagaggagagaagaccagcgtggttccggtgagagcaacaaacatggccatgtggatgttggtggctcgggcctgaggaagacccttggccagcagcagccaggtctggaagtagggatggtagatggcgaacgccatattgtagagaccgatgatgcagccggggacagtgacaaatcggttgtacatgagcttgtacttgaggaaggggtgcttggtgaagaagaactcccacagagggaacaccacgtagagaaggaaggtgcccacggtcagcatggcaatgttctcgcccagcttccagttgtcggtaccagtgcagaaggagatgggcacaaagaagagaatgagtccggcgcagaggaagaccagaccgggaagatccattcggatgatgccggtgacggtgtttttgaaccaggttcggttgggatctcctcgtcggattcgcagtcccattcggtaggccttgattcggaagtagagcagggtgaagaggaagggcagcgaacagccgggcacaatgatgcaccacatgcccattccccactgccaggtggagtttttgagcacggctgcgaccatgggacccgagacccagggggtgaagaggttggcgatcagggtgatggtctggaagaatgttcggtctcgcagagtcaccgtgtcggcagcaaaaatctcgtacatcatctggataccaatgtcgcccaccgagtagaaggccagggcggcaaagtaagtgacaatgttatggatacccatgtagagaccggagcccaccgccagacagacgaccgagatggtcatggcctcgaatcggccaaagttgtcggccaacttaccacagagagctcgggcaatcaggaagatgcacgactgtacaatctgcaccgaggcaagtgcgcccatctgggagaattcggacgaggcgtagacaatgtaggaggagaaggaggaggacatgatggtggaggccagcgacatgaagatgaggaagcaccaggccatgatgagctggtttcgactccacacctttcgcacaatctccgagtgagtcagctgcaaatcttccacttcgtcattggggtcaaatgtctcggtggccgagttgtagtcgtactccggggagaagaagaaggtcatgatggagcgggttttgggggacatggctccaaagaacttttcagcctgacggtccttgaagtcgaacacatactttgcgtgtttgtccaacttgtccagagtgtccttgttcttgtgcttgagctcctcgatgttcatggtggttgttggcatcgcaaacggtgggacgagtccgttctttatatatcgtccaacgtccgctccatcaacacacaatgacactccaacccgtgccctcgccatgtcccaggttgcatttaggcgactcccgggcttgcattagggcgcgttagatgggtttcaagcgctgaggttagccccacaggggataggcagcagcatctatagcgcggagcctagctcaggtttattctcgttcaatgaccccaatgcgggcatcgactggaatcgcactgtagtcggtgcttctgagtcctcagccgtcctgcgagtcctcagccgtctgatcagcgggcggatctgccatctgtgcagtcttatctgatgcgataatcggagagagggcttggctgaagcacccgatcgacagatggaacgctgccaagagccgacgagtcgcttggtcccacgaggggaggcttgagcagcagacaaggactctcggcaccgccaaacgccagttatgtccatggcgttaagcagcttggcaaatcagagtttgtcaatctctaaaaaaactcttagaaaaatattaaataagaaaaaaaaaacgcatgataatctccagaacacagctccaccaatctccacgtcccacccttgctacgctagctagaggtgttggcttccacccggtttaaactggtctttttttagagcatctttcgtccagaacaaaccctggcgcttcatacggctcaccaacacacgcacgctccagctatgcctcactggtctgtgtttcacgcgaatctatgataacttggtgaggagtagatggtccaggccagactggagtgggagccacgatcgttggttccttcacacgcccataattatcgtcgctattagtgtgtgttttttccacccagacaaccgaaactcgaaatgcgacatttatgaaaaacttgcagatgcgattgattacaggatcagattaaaaaccaatctagagctgcaacgtaccgccgaacccaacccgcgtcaaaggacggccgtacgtctgtactgtagtctttctttctgtccaatgacccggatcggagggcttcatgctgtgcgggtttgctcgtacaatggttagactctcgtatagcaaacctcctaaaccgcccttgaaactgttgggcggcttgcaacttgcggcttgccggattaaaagcctgggcgccggtacacagggccactgcaacagccatgctacgcagaggacactacggcgtctggctccgatatgtacactactgtacactactgtactgaatccttggcaggcagtagtgccatacaagtagagttagtgatattattaagagttacaaacatgtgtggagggaaacaagtggcatggacacatacctctgtcacattttgattcctgaagcgtcgcaaagatggcggaacatgcccccgtcctgtcggaacagctcctggggactgccgtactgcagcatctcgccgtcttccagcaccagaatccggtcgtagttgacaatggtccgtagtcggtgagcaatgcacagaatggtgcagtggctaaattcctgcgaaatagtctgttgcacgagagcatctgtctggtagtcgacattagatgtagcttcgtccagcaccaaaatctgcgagttgcgaagcaaagcacgagccagagtcagcagttgccgctcgccaagagaaaaattggtaccatcagagtccaccttggtgtcaagagccacagtcagcccacttcgctgcagacaagaccacatttctgcatcggtgtgttctcctagaggatccagattagatcgcacggttccaccaaacaagacactctcctgggggatgatggagagtccctttcggagctgctcgagactcatggaagcaatatccactccatcaatagaaatcttgccggtttccagctcgacgatccgaaacagagactgcaaaatggtactttttccggctccagttcggccacaaatcccaatcttgtgtccaggctcaaacgtgaccgtcaggttcttgagaaccagcgacaactcgggtcggtatttcagagacacattgtcaaactcgatctttcccaccgaaggagtgctgggggaagctgtgacggtcttggaagagccctcggacgtgatggtgtggtaatggaggatccgctctgcggcattcatgcagttttcgagctcggaaaagccctgggccatcatggagaggttctctggaatggacgcagcctgagaaacaatcagacccatgttggacggtgtcagatgaaaaactccaacagcacacagaatcgtacagataagaaccacaagagatcccatggcatcgagacgaagcgacaaccaccgctggttggcagccacaataaaataggccgagttcataatgtctagtgtaccatggagccgagaaacaatcttggattgagccccgtacatgacaataactgacatgccggaaatgctctcactgaagactgacagcatggccgatcgctccaacgagtcgattcgttttacctcccgagcagtctgacggtagtaggacaaacagacgacaaaaacaacaatgataggagccagaacaagagccgtgtagggtacaaacacaatggtcatggcaaacgagcccacaaactcggtcagagagaagaagagcattcggtaccgcatacccacctcgttatccaaactgtctgtgtctctggtgaaccggttgagaattcggcccatgggagttgtatcgaaaaaggcaacgggggctcgaattatggtctcgatggctagattgtgcatgttctcgatcgagcgagtacccaggacctgagaggccatgatgaaacacgtgagcagaagcaagagaaccattccgagcatgatgtagattcccatgtagaacccctttgtagtgaggaaccgatcagctgtccagaaagagagccaaaccgaggcaaagatggtcagaaatgccacaagaagcatcagaaacgcacatagaacaatcagggcaatactgagagccttgttcttgttgctgaacaaaatatatcgcttgtagacgccaaaaccaaccgagtctcggacccgttcctcttcggccatcatgtttgccgaaatagaagactccatggacaccctagatgttctcttggtagccggagcgaactcgattttctcagggacctcgacaagttcgacaagttcatgtttcacctcattatcgtcctccatctcaatctcaccgcgaacagcaccggcttcaatgagagctctaaattgaggaagacggtcagacagctctgcaactgtaccctgatggatcttggcatggttgtcataggactgagcatccggtttctccatgaagatgacatgatcagctcgttcaacaattccaacttggtgagttgccagcactcgagtagaatccttcagataaccatcaatgcactgatcaatcatagcctggccgactcgggcgtcaacagctgagagaacatcgtccataatgagaatgtcgggtttgccatagacagctcgagcgaggttgattcgggccttttggccgcccgataccgtgattcctcgctctccaatcatggtcttgtctccgtgctccatatggtcgaggtcagaagccagctgacagactttcagaacgtgtctgtacttgtcggcatcgaattctcgtccaaaaacaatgttttcacgaatagatgcgttctgaatccagggctctaggcatccaatccagttggaagacgagaaagacaatgagccgtcggtcatgagcatgaggttggtgagtgcagacaaaagagacgtcttgcccgatccaataccaccgacaacaacagtgagtgagcctggtttgagggcaagattgaggttgttcagagtcaaagaaacatcggcttcaggctcgtcgtccgaagattgaatgtcattggactcaaagaaggagaacttggaggagatggaagactttcgagaggacttggccgacgacttgcctgaaagaaccgactttccggaccgcagagtcttgatggactttattgagcgggtttcggacttttctgtgggcttgtgactctgtttctcctctgaaaagaactccatgggctcatcctggggccattcgaagcatccgtcttgaacaagaatgctttcaggctgctcagtgttgatagcaatgttcgagacaccctcttcggcgttcagaaactcgtggatacgtcgcagagacattctggcatctcctacatactgcatagccatgggcaattggatcagcgcaggtagaagcaggttgaacagggtcagagaggagaagatcttggcagggtcagtttcgttgccaatactggagtaagtgatgaaggacagggcaccagcaatggtgggcaagctttcaaacattccaaacgagataccccggatagagcccattctaatgtatccattggcttcttctcttcttgccacctgaattttctgcagagtaggaatctcccagccgtagtacttgatgattcgaatgttctgaagagcgtcacggatcagggtcactcgcttgtcggtccatttgatgattcgacgtctcattttcatcgtgtagcttgtgatgtaagccacggatacaatgaagagcatcatggtggcgacaccgacaagggctgattcgtggagattgacacaaagcacggcaattgagcatgccgtggtgatggggaacgcggtgatctggtggacgaattggcaggcaaagtcgactctgtgggcgtcgagggctgccaggttggtgatttttcctggcgggtggatctttcgggcggagatgctgagtttggtggactttttgaaaatggtgccaatgagtgcggctcgggatttggcgccgaccatctgggcggcatagaacgagtggttgaagaagaaggtgacgcccaccgccagcaggaacatgccgatggaggacccgatgccggttcccatggggtagtttcggtcgtagtatcggcgctcaatgtagttgataagttctttggagacgagggcgcttgccacagcgcagagttcccgcaggatggtcatcagtgccgcgaaccaaaactgcaccagaaacgtgtcgttcagcgccatcactaggggtctgctggacttgttgagagcagcaatggcctgttggcgaatgtggtcgtcatggtggtcgggatcggccgggtcgtcgttgtcgtagtggattccgggatagatggacgtttttgtggtggttggttttttggactttttcagcttggcgatcttgcgctcgagaagctggttgtagcggaagtcgagacgctcttcgagtctggcttgtagttttgccacctgttggttgtcagccacgctccacaggtcatttttttcgatatgtcggaggtatccggtctgggttagttgctgtgataaggcagcgataacgaaaaactgggagatgaaaggtaaaagaaagatgaaaaaattgaaaaaaaaaaaaattgaaaaaattgaaaaaaaattgaaaaaattgaaaaaaaattgaaaaaacatgaaaaaaattgaaggaaaattgtggtaatcagaacattgtaaatgattcaaaactgcgattaattcagaattgcgattaattggagaatggtgataatgaccctgcaagaaatgccacgatgaaatactgtttcattgataaccactgaataacgatctacagtccagtttcccgcttggtgtgaatatctcctcatactcaccttaagaagaggacttaaccatgtccaagttgctctggaaaaccaattggcctggtgctcggcactgggctgcttttcagaggggatttcggggactttgctaaagggtgcaagccagtggattgttctcattcgatagacgcgtgccgtctggcccagggaacacgggtctatatatacatgcgacccttgagctagtcgaccactgcagccagcgtcagagggcctagatgaccctggtgagctatagcacggctcagctaatgcaccatgacagccacgcacatctggtggggtggaggaaggagtccgaagggtggagaaacaacagccaaaaggaccacaaaccggacccaagctgaagtgaacgtcgacccgtttcttttttgtgtctcatctctatctcagtagcagctggttgcatgtcttacggtcttttcggaccccgaccactcccgtctttgtcccttgcactaacccggcgcctagcccttttgacaggatacgacaagcgagccttggcgatcttggctcgacggagtgagtgacttacaaggtccattcgacgcctcttttgccgttcaaggggttgtttctcctcgaaaatgtctccattccgtctcgccgtctctctgatcaatctgataccactgctgagaggcgctaaaacgacgctatgatcgtcaccacagcctttcattggtctggggtctcaaagtgtaagttgataactgactgttatcaacggacaccgagctgtcgaccccgtatagcgagtagagaacgtacgtgtagagtactgttcactcgtactcgtgctgtacccgagtctgtctgccagtacatacattattccataaaccaacaaacgccatcgtagaaatacataatgggtgattggtactccagatttagcaccgacttatgctcacactactgaactaacttgtaccatccatggtcttcttcgaagcatggctccttcctttcggaacaaagtctccgtagattgctatccggacatcagataatcctgcccgagacagccgagcgacaaaggcgaaactagttgaaaagcactcgacggaaaacaaactacgttttaaaccctggctagcgatatgcataacacttttttaataccacttattggcatcgtctgccaccaaggtacttacgagacggttccatgcgtacgtgttgcgccgactaaaggtccggataagttttggatgttgggagagttcccaagtaatatatatatataaatatactgtatataaaaatatataaaatatataaaaacctgggctcttagcgtgagttcaaatctcacgtatgtcatttttaatacatttagcagtgagtacagtacgagtagaagatggaagacagatcttgtcagctttctgagcctccctgtagagaggaaagttcaggagctcacgggatgaatactcaaacctggaggtgatatcgccctgcgagttggtaacacccagagactgtagctggccgagatttctcgtaaatctgctggacacgagcctcagcatccatgtctcgaaggacgagactcgcatgcgacactgtacgacctggaaatggcatcagccatcaggctgggctcacttgggatgtacttcaccacaaggtcgtaatccaggagtgccagtgcccgcatggaatcaatgcctacacaatagctaaggcttcagtctcagtaacgccatagttacgctccgcttcagtaagaccacggcccgcaaactgaatcaaccggagtttatcacctggtggatatgggtgagggcagtgccaatgccatcgtaggaggggcgtctccagttctggattaaaagcggtcaggatctgggcggcggatatcaaagctttcagcttttgaaagtcctcacacgcgccttggaccacacgaagggggtatgcttcttaaggagctcattcatgagccgaataacagcggaaaagatgggcacgtgagctctacccatgaagtaacgggtatctctaacatccttgggagtagggaaacgaaacacagccttagtatgagaggggtccacttggagaccctcaggggtcttgagagacaaggattttcgtttcctcatgagcaattgagattttggactttttagtctgaaggccatacttatccattcgagcaaaaacaccgtcaaggtgttccaaatgctgctcccaagtgtcagagtacatactgatgtcatccaaataaacgagtagtcgtcagtgaattcatcaaattccgagtccatgttcatctgaagtctgcaggggcttgcgaaatgctcataggcatacacttcctaccaaactgcggtcgcatgaccgtaagttattggacagctttaaagggaggggtctagtaatagccggaggccagagtccttcttcttgttcttgttcttgttcctgtttccacgataatcgccgctgccgtagtgcgagtagcagagagggcgagccagccatcctcgggatagctgttgccagccacacgggtagcttcttgtcgatccggaatcgtgaggcagaaaaggggccccactttttaacgaccgcgctctgaagggcagtgcgggaacgtctgcactacagtcgagaaggtcctgagagaggagggttagagccgaagcgggagcccaggtcccgaagaagtccaagacctcggaaggacaatgtcgcataccctgcttcgtcttggcaagtgacagaacagactgccggagagccgcccaggagttaacctgaagttgtcggacgggcatctgagggagctgtggcatcaacttggaaagagtgggcaaagacgtattttaaagagtgtctctgtctaggcactttgagcctttaatagtgcctctatctcggcaatttgggccatagtaacaaacccctggcggggggttggtggtcgagcgtcgtccgcatgtggagcaggtggtttgtcggccttcggagtcagtcttgtccggacggtgtgcagcacgctcatcacgctccgcggcttgctgagcgagctcgttacgtcgagcgttcggatcgtccatcagttcgaatcgtggaatatcactatctaagctgtcgaagcccagatcacgcgaatgaagaaaagacgtgtatttgtatctagcggagagttggaacgcttactaagagctccacaattttcacttttcaaacttaaatttaggttcaattaagcactcgtatcgacgcgtaaatgacatcgataatttcaaaataacccttcttcatacacaaacccggccgaaaaacgactgagacaatggaaatgtcgtcgcaggtgttccgtgacgcaactttaggcgacgatagaggcgaagcttcgaagaaggctatttcgaacgtataccagagcagccgggaggagcatttcacaggcgcgacgcgcaggaacgcgacgcagacgacacacccgcgaaggaaacgaacggcgacgaagaggaaacgaacggcgacgaagaggaaacgaacggcgacgaagaggaaggacatgggcaatattacgacagcctggacgacgtgatcgacctgactggggcggtgttggaccccactgggatgctggatgacgaaagttgatggatatcgtacgcgactgcgccggagacgttttcgagggcatcgaaaatatcgaggaggtcattgataagctggagcatttctacacacgatatctggagctgacacttgcaaagtccagcaaaacaacaggtcgaactcgcacttacccgcaccgtcgaggaaagatgttggatgctcacagggccttgcttgccgccaaagtcgaagagctctacgccaccaacgggaaacggtgcaacagcaactggacagatattatggcttacgccgagtctttaatgtgcctcaaagacgatgacatcgtgggagtgaggcagtacttgcaagacaccaccaggaagttcacccgtcaagagaagctcaactctgatccaaataccggcattggtaatgcacccagggccaatggtggccgttccaagtacctccatctcgaaatcgcactcttcagagtggcgaagctgctgcacccggacctcctgctgaacatgcgccaggctgaagccattgtccgggcctgtatccaaaggctgggcggaagcgcctatcagggggtcgttgacctcgttgacatcccctcttccaagtggatcgccaccctattcaggtacgcagggtaccggtggcgacagcaggctgcagagcgtgatcatgttgacgtgagggctgctctgagaggcaccattgccttgtggccaataatcaagaatgttccgctcaaccgtatcttcaatgccgaccagacgaactgcgagttgacgggatctttcaacatcaaatgtctcacgaagaaggggagcgtcagcaaggacagcgggagaggcggagactctttcacgcaattttctgttgcaaacatggacggcaccaagaaatcagactttttcctgtatgtcagagaccttatgggtgaagcccttccagactttcagcttcatctcaacgaggtcatctctccagctcaatccaagaagttcgaggaggaagccaaggcaaagtatgcgtactttggagatgaaatcaagaccctgcgcgcagctctgaatgaggcggtaaaggaagttaatgccaccgaaaaagttgtgacagctcgtgccaatgagctgaaagccgtggagaatgtgatcgggaaagaggcggcagtgaagaacagggaggaaaaggcaagggagaacgcggagaagaaggcgcaatcaaagaagaaggcggcggagagggcggcgagacttttggaagaaaagaaggccaaagctgcggcccgggaagtgaaacgattggctcaaatcaacaagaagagagaagaggctgaggcgcgactcaggaaaaagggaaagacgatggttcgggaagaagttgctacgagtggccaaggtatcgattctgccacttgttctctctctgacgttcagccagtcgcaatttgttctctatctgagaacgttctgccagccgcctccacttgttcttcatctgatgttcagccagccgtccctcagcagcccctcagccagcccctcagctagcccctcagcccctcgcccccgttggaggtgttgctgagccagaagaccccagaaaaacagaggccctgttgaatcttctcgaagcccaagactcccacaatgagaggatcgcgcacgtggccaagcttgaggaagacatccttgaactcaacctgagatggcagagactggagattgagcatattgctgagctcaccttggcgatggtccagaaactcccagataccaatgacgagtcctcccctggcgcagatgggaccgagaccttctacgatacgtggctggagcttccccagatccagactcctcataaagatctggccgagttgcgaaaactcgacattgagtggaaaaagatccctgcaaggaccaggagaagcgtgacgctctcgcggctgagatggaaccgctgttctagagtgtggcgagaaattacttttcaactgcgtctaaaactgtccccgcgcatctcctcaatgtccatgttatccgacaggaacacggttacatggacacgatcctgatggtgatgtggctcgcgaactttgcaaacgcaaatcctgggacaccgtcagatccagtcgttctcattctggacaacgtcggcttccatcgacgggcctaccgcattgtcaaggactggcccgagttggcccatgtgaaattcctcttcctgccgcccaattcggcctcctttacccaaccgatgaacctgggtatcattgcagccatgaagcagagctggaagaagttcgacaagatctttcatggcagcattagtggcgtggatggggataaccccctggtgacattcctgcatagactgaattggttggcaagatcttggaaagagattcctgcttcggctatcaagaagtgtgcaatgcacagccctctcttcttttgtcacgctcagcaaaatcgtcttttgcctgcgtacgtgaagcgcaatatggagattgaggctctggttccttatgaagatagatctcctcgtgttgaagggccggtgatcggactaaatgaggcaggggtgcccacgaagcgggcagctttggcccagatcgcttcaatcccatttgaggttctgtttcccccaggaaaggcggtcttcgatgctgaaattgagacactcaagggcaaccgagtggagcctgaacgtctccgaaatctgctttcccagaggcagaggcgtgagcgtcttcgagagagacagaagacgactgccgagctggtcccgcacgatatgcaagccacagatgagattgctgtgtatgtcgatgactcgcccgatactcccgtcaatgatgtccaggttgtggaccagcgagcgcggcgccgtggcgacgagaacgttggccctcctatcaagtttgtggcgtatgaaatgggtggctcgccgagaagaagatgtgactagactttggccgagcttccgaccgataatgtctggtatgccactggtggatgatgaaatcaggatacgacagtcatcggaaccgagcgctatgctatcgacgacatcggtcgtaccgggacttgtggccgccatattgacaatcccctggcagtcgatgatgctacggtgtcgacggtggatagcaacgtcgacctcgctgaacccgattcgatgattactgacttgactgagactcccctagtcgataccaatggctcgcaagggaaacgagctctcgatgacatcttcgaaggagtcctcaatgtcaacaccattaccccagccaagcagactgcaaccttgtcttctgggggtaattctgagggtaatgacgcttcccctcacccatggctgtccgccccgatgacgagtcacagaccagccaggtgtcgttgtcgacgctgatgatgataacactgacaatgttgacgctgacgacgctgacaatgtcgacgctgacgactctgaaaatgtcgacactgacgatggtgtcttgtcaaggtttttcgcaggcgtatgcgcaccttcaagaagacatcacaccacggcatcaaacgccgtaacatcgacctgaattgcgatatacggttcgccacttttccttagtattaatttgagagaatgagtccattctagtcgacttgcgcgctaaaaacaccgaatgggaggctgatggtgcgtgatgtgtaatcataggcatattcggtaaatatctcgcctctttgtagacgtgtgagggcatatatggtattgatttgtagcagtagttcgtcgctatcttacagtacactgtacttttgttttagtactattattctgcacgtcatgatcagatggcgtgtgcaattgttcttgtaggtatacgagtatgtacatactgtacgactgggtaagtcttctggtaacttttcgggtagttttacccatataatcaaacagtagagaccctatatggatgtcaatagccattaatgcaacttttcgtgtttccatctttcccaaagcgttccttcatatctgatctacaagtacatcgtgataacgcagttttgatcatacaatggaagaactgctaaagggagaggaaaggtcttggatcaggatgtggccggggtatctaagagatattcaaacaagtgtttgacacgaacaagaacctgtgctatatactgtctctgttgcagagactcagtcaactgtttatagattttgattggggaaggtatggtactgtactgtacaagtaatttgggtacttggcttcattctgcaacagttcaaaaatgaaatctgctgacttttattatggtaagatcctctccagtcccctcattctccttcagtctcctacaactccttgatcatgtctcgaatcatacttcagccgatatcaggaccaaagagaagagattatggagaaaagcgagtcagtagatgagtcacgtgataattatggggtttaatacttgtgtttgaataggaagaagttctagggaaagcggtttatgttgagggaatgggttagttgaatatagttgaaaggatatattgtttagttggaacattagttgacaatgagataacatgatagatgggttcaaactcggtgaatatggacctgattttgacgggacagaattgaagctgcttaacaagttaatatatcattttttcttttattttttggtttaccggttcgtctcaatggttatcataccgaaatctaccggctcagtaatcgacacctagaagatgcgttctaaaagctcgtatcggtgaccttcgtgccaacatagtcggtttgaagttcatatttgactgccatatcaacttggtgtcccctttctgaagcattctgatcccaatggatgcttggagctgctcttgagactcggacatctggttggatctcgtgtccctgcctgtcacagtccatgtctacggacaatcgactacagtaaagtaccgacacccgatttcgcaatgttgcctcgattgagtacacaataggaggtcgtatatcagcagtatattcatctcgtacaacctcggttcaactaaaaccactagggtcaaactcaaccatcagatcagtgtactgcttaccaccgtcaacccagcccttgatgcctccctcaagcacatagacttcaatatccttctcattgtgggccaccaaactgtcatagaaccaaccggcagtcttgaccgccctctttcgagacgaccagcaatgcaccacgattctggtctttcctgcaccctttagcagccgccagatatcctccacagagctgtaaacgccagtgtagtgggcacacagagcgcccctgatgttgccgccctgaaaatcgtgttttcgaagatccagaatctgggtcttgttgtcatctagcaatagccactggcgaacctgctccttggaggccagtggagccgttcctttgggctccgggtacttttcgagccagtcggcgacttccggatgcgttcccatttttgtgtccgagtggtttggtcctttttcgggcgacagccggggtatttatagctacactagtcgtctgacgggttagtactgatttgtagatgcacttgggtaaccgaggatgtaagagtcttgtgcgatcaaaagtgagcgagtggatcggtcacgtgacgtaatgactcgatcgcgtgacgtaatggctcgaacgcgtgacctagtgtctgtatcacgtgatctggggattatatttcacgtaatgattcaatcacatgaccgggtggccccagatctaaatcttcggtctccgatagtgtgggttttgacggcttggttaattagtgccatctttgtttgataggttaataattgtctttcggactccggcgatgagaatttgtaggccgttggagactgttgtattgaccatttgattggccattgtgtgaccatttaattgacggttggatcgacaaacatgttttgtcactatgaactggtcctcttgtatagttagcgtacttggagcagatgggtaatctaactaaataattcataaagtcaattaaattgatggaatttagttgagtcataacaattccgtacaataccgtattcgcaactacaagtatcgtacacctacaaaaggtgcaattaattccgcaacatgagaccaagaggacggtagtttgctgaagcttgaaacttttcatcattcagttcgtggtagcattgtcttatctatacgactcagttccgataatggatatccgtctgattacttctcgactagataaagacattactctactctacagtatactacagtatgaacagagctttggttctatgaatgttcatcaagtccgtgaaatggctctaagaaccgctcttcaatccatacattactatgtaagaccgcacagttggttaaccatccgaggttcggcaatgagagcacttatgacaagtgtatcttcttcataatcgctcccctatcggactatccctaatgtatgtattttacttgtactttcatcacgaactatcaactaaatataattactgcctctctctccagctcttcgccgtctcttgacactactgtactgtactgggctggctgcacatagtcgatactacaaaagcgggtgctccgttctacttgtactaccctagatacatcatcaacgaataaaatagataaagtactttgactctaccagggccagcctgtcaagcaaaaagtcctactcctggtcgggagactcatcagtctcaacattctcttcagtctcatgtccctccccgagatcttcaatgagacatccgggacagaagacgggacagttgggatggttgcagaatcctccgccggcgggagcgtttctcttctccagatcccgggcacttcgagaggcgattcccatgatctctcgaacgacgctggcaagcttctggcctcgcatttcaggggtgacggactcccgaagagttcgagcgtggtagatggcctcgtcgtcaaactcgggggtctcatggctgttgactacaatcagaatgggctcgttctcgccggtggagccggacgaaacgtccagatagttggccagcgagttgccgccagcaatggaaaacttcttggtctcgccgtaaagatagttgatatcgtggtcaatatggtccaccagagccacggccaggtgcttggagaaaccgagcttcttggcgttccacttgttgctctcggcatgcttggaaagagcagagtgggtctggtccagcagagtcacggtgaagtgctcggccgagacgagtgtagcgagaagaaggggaagaagttgcatgtttgagtgatacagaagagagacatactggcccccattcacccccttatatatgtgcttgcccaactgcccacctttccccgagacaaaccctgatcggacgagtttccgtcgatcacccatctccaccttgactaaactcaatcagcgtcggaaacctcgataacggcgataacgcgggatccgtcttggcagatcttggcagaaggcttagctactgaatcggaacgaactacgcgggttgaaagacagaaaagaacgaaaagagattgaaaggagattgaaaagagattgaaaagagattgaaaagagacctgacgcacccacccgatcattctcgacgtcctctcacccgtctgactgtacctcaaggtttgatatggccgggagatattatctgcaggatacgatggtagagtggataaagtgtgaatcagagcaaatggtggggttacttcggagtagcaatggacatttccggacttttccttgtgaatataggtgtatatacattttggtggtcggagttctgtgacggaggatactcccgtagatagcatccactaccatcgtcatactgaacgccgacgtgcaccatcgtgtgcaaatccgtctctattaaaatccgtctttatgcacaatcgcagcgtcggagagggttatcagagttctgtaccaacgcctcgaatctattggttatctatttcaagtcttagacattgtatttgaaaaagactccgagcttgtcaaccgcctcgtccacatacttgtccttgtcgtaaagatcaaagtgagaagcatcccgaatggtgaacaaactgacgagatcgtctccaacctggtccaacagctgctgactgtaccatttggtggtggcttcagtgcccacaatcagcattgtaggctgggtcaaaaactcttttgcgagatgaaaggcgtcgtaggtggccagctgggttaaactgcgtccagtgaacttgctgggtgcatccggatgggctccccgaagagttcgatagtactcgtatgcgtcctgctgctctttagtgtccgacgagttctttgtctcgggggaccaatccatgatgagaatggctccgtgattggcttcttcggtgcgggcctcggctccttcctccagcagatgtggggcaatgtctttgcgtcctccttcccatccctctctaaacatctgtccgatattcacacagttgaccgctcctaccgccttgattcgatggtcgttcatggcggcgttgatgacgtagcctccagccgtgcagatgcccagagcacagatcttgtccacgtagtccacggtggtcagataatcaaccaccgctgacacgtcttccacacgaacataggggtcctccagatgccgtggagaccccgtgctgcctccgttgtacgaggagtcgaacaccacggtcacaaaccccttggctcgggccaatttgcgtccatacacgctggcacactgctccttgacgcctccggcgggatgcgcaatgattatggcggtgtacttgttggtcttgttgaaatcggacggaaaaaacaagattgcggcgttggtgattccggctccattgcggttggctacgctcactttttcctgcacaactttgctgtcctcgccgtccgaagacgacggtggtggaagggcgatgatggccattttctgctgagcttggttgtaccagttgttggacatgtctccgattttcaaggcatcatttgacatgtctgcggcccgtgcataataatgtcgcttatccaaactttgattgaggacaaggaataagatggaaaattgaacaaaaaattgaaaaattgaaaaaaaaaaattggaaaattgaacaaaaaattggaaaattgaacaaaaaattggaaaattgaacaaaaaattggaaaattggacaaaaaaatgaattaaaaaatgaattaaaatgaacattttaaaataaagaaattgttcgacgaatagtattaaatcattacaatcagcacgtatatctgtgttgattgacctactttttgctcctagtcgtattgacagaattactgctctacttgtactcacatccaataaaaatacattatctatccctctctcaataaatactacttgctgtaatgccccgatctagtgggctggggcatatccatccggttgcggttaaacatgtccgaatggtcgtggtcctgcttcagcttgggctggaaactgtagtcattcttggccacaggaccgtactgcgacttgggcggaatgtatcccgacgactgtggacgtggcaaccctccaccctgtcctccacctcgcttttcggccttgcgtcgctttttgctctcctgtcgttcccgctcccgtttctcccttcgcgcatctcgtccaccaccaaacccgctgttctggccctcattccctcggctaccttgattgttatagctgttgccgtaactgccgccgtaactgccgccgtagctgttgtgtcccctgttcttctcccgctccagatcgtcaaagtaccgtttctggatatcatagcggccctttctgggcaaattgccgccggaaaacgccgacggctccttgaatcgcaacgtcatgttgcgggtatctgtgcactcgtcaccgtaatgtccctgaccgccgcaatggtagcaaaagacgcagttggtgccgtgggggccccgtcggtccttgacatagtctcgccagatcaaatggcacttgtcctcggtgtggatgcgtgaatcgcaccgccagcagaaaatcgtgcgcttgctttgtgtgcactcggctcgtagatggcccgactcgccacagttggagcatttgcgtaacatggtgcagtcggcggtatcatggtcctccagagctccacaggtgaaacatcgcatcaccttgcagtccgccgaaatgtggcctcgcttgtgacacgtccgacacgtgggcccttgctcctcctccttaccgaaataccggccctcgcctctcatttcaatgagctgatcttccccatcatccacgtcgtccacccccacggactggaacgcctccacgggggttttgctgggtttttccgtgtccgagtcttctaaaacggtgtatgcaggcgcactggcctctgtgtccatgaagaacaggtcagacacgtcttcgtcggaactcatggtcgttttgtatatgctgttaagtgttttgtgagtaccgttattttcaaaaaaaaatattgtgcataccactaatggcctgaactttattttgggacaagactataaagtagcgagtgtacgccatcacacaggtgaatcgggttggtttaaggggatgtttaggtgtgtgttgtacttttttgtcttgttttttctcctggtgtgtttgtatatttttcctgatgtttttttctgattttttctgatttttgtcgatttgcctgattttcctgattttcctgattttctcaaatttggtatatattccaattaattcagagtaaaaaagaaaacttgtaattcttcaagcgaaactacttgtacactgccgaattgatagtcctacacacattgaacatgtacaagtacgataccggtacaatacccgcagtcgtactcgccgtacagtagctccttacaatatatacttgtagattccatatgtacttgccctgtggtccattttttccttcccgtgacccatcactccactcaactgaagaactttgcgtactgagccttctgcttcttttccttcatttcactctcctgcttgagagccgtcagactcttggagatttggggatcgctcggcaacagctcgtgggcctgttccagatcattgatggcccgctcctgcttcttgagtccctggtatgccgaagatcgtcgcgaaagagccttggccctgtccctggaggtggcacactccatttccagggccgaggtggtggagttgatgacctgatcgtactttttcagctgcagagccaccagacccatgttttgattcagcgccagtttggccttttggaactcgtcgtaagcctttttgctgctgtccgggtccggcgacagctcaaacacatatctcagggcctttttgtacttttgcagagccactcgcagcaccatggccctctcctcctcgctctcggcgtctccagccatcttgtacacctcggtggcgtacgccttgatctccagggtcactctgagggcctgctcggggtcgtcaaagttgagttcgccctcctccttgcccacattgaagttgtcgtccgggtgctcttcgtacttgtcggctgtgagtccgtcctgggagccgatgaagggcaagagcagctttgcgtctcgtttcagctccccgcagttggtgatggtaacgggcagcacgggaacgtctccgggggccgtgtccagctcctccagctgtcgaagcacacttttgccggccaccaccttgccaaaggccacatgcttgccgtcgagatgcggcgagcccttgagagtgacgaaaaactggctcttgttggagttggggcccgcgttggccatactcagcacaaacggctcggcgtggttgtgcacaaagttctcatcgtcaaactggtcgccgtagatggaggttcctccggtcccgtcgccgtagacaatgtcgcctccctggatggcaaagtttcgcacaatgcgatggatattgctgtccttgaacgtgaggggcaccgagccctcgggggtgggcttgtctcccttgcacagcgcccggaagttggccgaggtgagcggtgtgtcgtcaaacagctcgaagacgacccggccaaccggctcgccgcccacagcaaagtccatgtacacgaaagccgacattttcaaacaaaaaggggttgcgcgtggtcaagtcgggggtgctgggtcctgctttctctttctctgatctccgtctgcagcttttggcaatttaaatggttattcaccagctgaacctaaagcaacattttttgaagaaaagaaaaaaaagaaaagaaaaaaaagtgggggcttttgtataaaattatgtcgcttaattactagagtggggcaaaactggagacaaaataacggccaaaagagcccacatagccgaatacgacccatatccgcacgtgctctccacggaatagtacagacaaggaggacaagtacaccgacagtcgtccactatcccgccatatcaccgctcctggaccctcctgatccttgtctggagacgctcattgacgtcacgccagatgtggctcgggactgtagcaaggatgaacacaatggtatcaacaccgttcactggcactcgtactatgtagacatggccaaggaccagacacgctttgcagtcgagagacgcgccgcagagcccagacgggaaagatcagtcgtgtgaaataagagctttaacattggtgctaactggagcctgacccaatgaacctcagcaccggagctacagtataatcaggcctctgtgaagcgtgcttgatatgccacagcatccagtgatacctgtttggagccgccgattcgaaatcttgagaccaattggccgatctttgccatcaaagtgtccgagactgtccacttgctgtctcggaaaaccgcaatacagcccaaacccgagcccaaactgtttttcagccctcactagcaccactgtatcccttgcactagtctccccgtatagccatggacgtactgtaccgtaggttctgataacggttgtaggacaccattttgccgtagaataaaaataaaaaaaaatataaaaaaacaagtacttgtacctcttgggctataccacactggtgaatgcgctcgataaacgagtagccagagtttgcatgtcttatatcggataatatcagcagaaaggagccgttgacagtccccgaagccacacacccgtcagtgtcgacagatacgatacaatacgagaatcgagcactgagatcgcttccataggactccataccgttcacggacactgaacgactgtctacacttgtactgtagcacctatcttgtcgtccattgacatgcagactttgagatcaaccgatccaatccaaccgatgaaatatggcactggctacagtctttggtgtgccgtatctacaagtagggttactccgggcttcggtccgattcactacagtaggctaggtatgagtacgagtgacatgaatggacacgggtgaatcatgcgcatgtccgggtacgagtatgaatgctgtagtgcacaatttttctactctacaacactcaaaagtcgtgcgttggctctgtgtcagtcgacggttttctatatcgatgcttacaaaaacatgccctgggcctcgagtgagtcaatcaaaggctgcagaggctcacgttccttctcatcaatcagatcaaagttgatgacaaacccgataaagtgggtaaacagagagttccagtggctctggatgcccagatggcacattttgtcaaagtggttgtggtaaatgtgtgcaaagacacggaacatttggcggaaaatgtttttgagaatgctgatgaaatgcggcgggaacggcacccccacctttgtggggaaaatggtcttgtcttcgagtttggacgtgatccacgaaaacgtgtaatcaatgtaagtggctgctggcagtcgcaccgccttcttggatgcgtctatccacagatagtccacgccgggaccggcgttcatggtgggacaggcctgtggggtcacaaactcggagatggcgtcgtagaaggagttgagtagtgcgaagaactcatgtgcgtaaagcgccagccactcgttggtgtcgacatagttgggctgctgcacaatggtcttgaagttgccggtgaccagcgcttggcgcacaaacggctggcacatgaacagcggcttctgctgcaccttgccgccattgttggagcttgccaccgtgttggaattggagttgtttgtgtagctggtggcccggcttatgctagagagagatgacgacgacgacactgacagcgacgacgccgacgcctgcagctggttggcctgtgtctgctgtggtttggatttcttggagcttcgtccgaatcctcggctgtgttagaagaggtcaccgtggcggcgtttgttcatactcacctgaaagagttgaagaaggacatggcgagtgtctatgtgtgttggtagctgtgtctgtagattgggctgtatctgtcttgtatctgtggtgtatctgcgatgtgttgtactgtactgtacgatgcggacctgttggtgtaatcgccgaatgtgtctgtctgtgtcggggtctgtgcttgctgtgcttgtcgttgcaccccttttgcgtatgtgattgtgctgggggtctaatggcgatgctgtagtgcggtggtgatctaaaaatggttgcaccttggtctcgatggaacgtgtatttattaaggttgcacgttgtgtgtgtggtggtcaatccaggggtaaggggggccgcaacagagacccagaaagaagagacatttggtgggtgggacagaggaactatatataggcagccggggctgtttgtgtctctggcgcgtgtttgttggccccaaatcgcccgctctcacctgacacaccagatgagtaagcactgtcgctattattacgatcgcttgacgtgtctccatctagattcgtacagtattcccacagatctgtcttgaaaaatagtgcgcgtgcttgaacctaatcggccgtgtcaatggggcaattgtggcgatggttggacggctctggtcacgggaaataagggcggcttcttggggaatttttggggtcctttttgtgattaattttggggctaaaagagtgatggggccgcggcggttcggtcggctcatcgggtgctaacagctctaccggtttacagcggtgaagatatttagtgttgcaaccggaaaaaagaaatgacgaccagagtcgaaaatacgaataaaacgaataagtcgaatttgctacgaataaaacgaagaagtcgactttgctacgaataaatcaaatgactcgaatttgctacgaataaatcgaatttgctacgaataaatcacacaatataccgtgtctacgggtacttgtctcgtagagaaagctgagaaaatcctgaaaatcgggacacaacatttcctgtacttattttgagacgttttttttatatttaatttttcaaagtattgatagactcacctcaagtatcgtacttgaatcttcaagtatcagtgggctgataattgagcccagtatgggaagccagaatgtcaaaaaatggcattgtacttctcaaaaaaaaacacaaaaactaataatcagatcacgacttctcaatttgctggggaaaatccaagtacttgtcacagttacagtaccaccatagccttgtctcgatatccatctctaacaccccacaaaacttaaccccagacatacatgagaaacaccaacatgctcaaccaacggctgtcgatagatggaaacaattgcacagtacggtacgtgggaaccgacgtgcccgtgtggcccgacgaagaagcgatcggcgtggagtgggacgatccagctcgcggcaaaaacaacggatcagtcaagggtacacaactgttcgaatgcacccaactgggagccggatcgttcctgaaaagtgcgtcgttggccaaaaagcaggtccgctatggcacatcgtttgtggaggctgtggttgagcgatacgcgtcggaatcacgagtggacgagatcaagattggtacgaaaatgagccaggtgttggggttcgataacaagggtctggagaatctgacgagcataaatctggccaacaagggcgtttcagaggcccatgaaactgatagtctgcctctggctcgcgtggtgcatcttgatctgtccttcaatctctttacatcgttcgaaacggtgctccaatgtctccagacaacaccccatgtcgagtggatgtctttgaacggaaacagattcagagtggatgctgaaggtactccgaactcattgtttccctctcttacctctttgtcattgaccaacaccttgctgtctgagaaggaagtactgctaatcatcaaacacttccctaacctcactcatctggttttggcccataacaagaccatcaagtcgatcgatttgcgggatacccgtctgcagtttctcgatctgtcttacaacaatctgcatgacctctcacacttccacttccccccttctttgacgtccttgaacctgtctcagaacaggttggagaacgtgactgcggagactctaccccgttcagactccctcacagagctcgatgtgtcctacaacacccttcagtggtccgatttcgatcagctatgcattatttatccgtccttgacatccctacggatcaacgacaacccgttcaccaaagaagacttttccacaaacaatctttctgtgtcgcctatcgactcgcagatcattgcgcgatggcacaagaagctgagtacgctcaatggccggtttgtggccgaccaggaacgctcggacagtctcatctactttgtcaactcggtcatacaaggcaagattgactacccacgagacaagggggctaacaagacccatttcgacgctctggtagcgtcgctgggcatttcacaggcccacgcaactcccagggtgactgaaaactttcctactgcccgtcaggcgtttgtgaaggtcacgtataccactcgtgtcgaccgtggaacgagtacgacgacccagagactcaacaaacacagctctgtgcaaaagatgaagtttggcgtgctaagaaacaagggtttttcgcctctgcattcctgcaccattgtcattgacgatattgaggtgtatgacgagctcaagacgttggatttctacggagtcacggattctacaaaggttgacgttttaattcagtgattagtatgcgacgtcgccctataactaacacatactgtacagcgtccaaatatatcggtatacgtctcgaatggttaacagtgcgaataaatgtaataagtattttgttgctggtgcccgtacagtaccaacgagttttgctgcggtgtccacaccaacaagttttgtcactcgatatcaacctcgtcccctaagttcccaatctactcatggtgagaccacagaccgtcgcccagataatgcaaaagttccactccaatgccgttgttgacctcctcaatctccttggtggacatggtcagcttgcccaccgccagcgcgtgctccttgccctcggcgttgacaatcacaatttggtccttctccatgggctcgtcgggcagctctgcgcccttggatgtgaggcctcggcacatgatgtttgcgccagagagcacaaacttgatggcgcctcgatctgtctttatcgaggggaagtactgggggaactggtggaccaggtgtagcgaggggaccagctcgtcgtcaaagtgctggaaaaacatgactttaccgtcgatggtgtacagagaaatccggtcctggcacttgacgtggaccagctgggcctttttggggataatctggtcgacaacaggctccatatcggggaattgcgccacgagcttggccttgagagcccgctgcgacgacgacttgacgttggccttggagttgatgttttcgtgagagaatttcttgaacatggcgtgtgtttgaagatccagacaaccgatgatggatgttggcaccagatgatggaacatgcagatttggtgcacaaggttttgccgcgctgagtcagcggacgtctgagcccctctctcagaatctggaaaatcgcatgtaaggaccaagtcgcttactaagggcttgggacggtgccggtcacgtgcaagggtgactgttgttcccacctgggacgcacccggaggatgggagtataagaaggacatttatgtatgattaagaagacaagttatcaccagcctgtgaacgtattacagacagcgagcaacggttagattagacagcgacaatctaccgactgagaactattccgcagataagagacgatcggatcttacatcgcataaatccgatatagtgtaggggttatcacttccgcctttcacgcggagaacccgggttcgattcccggtatcggaggttcttttttggtctcgaaagggaccgtggccgattttttggaataatgaggatactggagtggatattttgtggtcgggatttttacgagtaaaaatacgggaaatttggagcgattccaggcggttcgtttgctttgtcgagatatctgccatatgtcgagtctataagtatgcagattaagaggtgcaagaggtgaatgattgagtatttaaacggaattagtaagcccgaaaagttgacatgacatatgccgaaaagacacacgagacacatgtcatccgattctgggcctctccatcgccgtaccattccaatatctgttcacattttctcaggatttttttatgcaccgttttatgcaccacaacttactcagttcattgtcacgatcaccatgtacagcacctatcagcgaccagcagggtaccagccgcgccagcagccgcagggcgaggaagatcgacgacctgcgcacagacggaccgttgaccatggctcggcgttcggcaagtggcatttggaccggctgagtgggcgcacgatccaaccggccaacatgcgatcggaacagtcgtatatcgtcgatctgctgcctccgtcggcctacaccaacatcaacgggtcgctgcggtcgaccaacccgcacattacgtccgtggcggccactccggccaagttcatccaggtggctctcaacaaagtgcggcacccggtgtactcagccacctggacgcctgatggacgacgactcctcacaggctccatgtccggcgagttcacgctgtggaacggtatgacgttcaatttcgagtcaatcatgcaggcgcacgagagcggagttcgatcgctcaagtactcgcactctggagaatggctcttgtctggagaccatgaaggcaacgtcaagttctggcagccatcgctcaactgtgttaacgtgatcgacaaggcccaccgtgagtcgatcagagagctggcgtttgcgcccagtgaccacaagtttgtcaccggatcggacgacggtctgctcaagatctgggacttccacgagagcagtaacgccgagtcggtgctcaagggccacggctgggacgtcaagtcggtcgattggcactcggagctgggcctcattgtgtctggatcgaaagacaacctcatcaagctgtgggaccctcgatccgccaaaaacgtcaacactttccacggcttcaaaaacaccgtcatgaaaaccaccttccagcccactggtaccaaacggcttctggctgcaggatgccgggaccgaacatgccgaattctcgatctgagaatgctcaactcgggctcgtcggaagcaggaccaacagcaggaacagacatgcccaccagaggagatcggtccatggccgtgcttcgagggcacgattcggacgtgttttcgctcacatggcaccccacacacgccaacgtggtcacctcgggcaccaaaacaggctccatctacaccttcaacgtcgacacaactcccgccggaggagcgtatggaccggactcgggaattctgcctgttaacaccatcccctcggcccacgactactgcgtttctactttggactaccaccccgaaggccacgtgctttgttcgggaggtctcgaccgaatgactcgtttctgggcacgacctcggcccggagaccccacctccttcagagacaagtactacgaacccaaggaggaaggcgtctcagtcaagacgctgcccggagtcaacaatgccaccagccgggccggcatggctcgtgtcgagcacgtgtctactcagcatttcaacactgcccagcccgaggtgaccgatgacgagccggtctccattccgggttttgctagatagtcggaaagagggacgtgataagaagcatacgacaccataacacgtgacacaatggacaggcgatacaacagcaccgagcatctgatatgatgggatatgatgggggcactaaacacagtgggacgtgactcaattgcccacgcgcaatcactcaagtgaaagtcctctgtctggcatggtcacaattagcataaggcaagaaagaccgtccatgcaaagtcatctcttgtctagtactgtctaccaatggtatgataagacttgtttttcatttaattaatgaattgtatgttactctacactcttgtatatactacatgctatgtagaaggccacaccatcgccgattcagagaaggataatataatgactattagtcgtacaaacaatgccaatcgaataagaaagcctctatagaaccgactggtggctcttttctatcaattgctatatcaatattggagacaggtagatgcgactatagtggaaatcgtagttggtattaacagaacccaagtacatacggtactgtagttgaaagctatcaattggaagatatggacgggtttctagagctcatgaaattgagaaaacggcctctcatttctatatttctatacttgttcactattcctttgaccaggtagatgacaacagtctaaactggactatatcgtgaaaaaaaccaaaagactacatcacaatacttttattacaactaatatacacatcccccttctctcagaatccgtccttctcgaattggtcgcctttcatcaactccttgatgcgtgcaacatatgcgtcgaacaaaggattttggaccacatccacaatgtggttctccatagcttgcgtgtcagtcagccattcggggtcctcggtctgtgttcctctgctgaccatcccattcccgctccgaacgtctgtatctgcaggggtaaagtgcttcttccacgacttggctcttttcggagagttggggggcgagctgacaggagaagcccccaaagaaggcatatcgtcaacggtgcgtttccacgtagaagtctcagagaatctccttggctgcgacaatggggttggcttcaccggcagataggactgcgacgacgatggtgctagcctcgcagaccgagagtgcttgaattggtatgggggagatgcttgcgacgaactggggggatcaacaaaagtctggctcataactggaggctcagtagctggaccaggaggttgggtgggagagagggtttgagactggagaaagggatcaatctgggtgaggtcgccatcatcatcttctccgttccactgagactctgggttgaagtttttgaaggaggtcagggtggcaccttcagtcctggtagacttgggagggctacccttgatacacactcccgcctttgatagcatttccactgcccggtcgtattcgtccatgtacgcgaatttgatttgaaagcgataagtcttggttagctggaaaaggatatctcagggtatcatgttagggtattgctgcgttggcgttgaaggtatcaataatattgtaatgtggacaaccacttgcgtcgctcattcgtaaccgactcgtggaacactcaccatggtatggaatctcctcaccaagtacttgaaaccaatccctggcggtctacaaatggccacaaacggcgggttgttctttccgtaggtggatccgaaccgctcctcaatctcgtctgtgtcaacatgctccaaagaggtgtttttgtatttgagggaaattttcgcgcccccggcgggcgtggtatcaatggagagctctaggggcgagttttggtatttggtccattcggacgcgtcgcggtcaatgctgctgctagccagtccctgcggagtcggcgcgtttttgtgcagatagatgtatttgctgatcctgaatgtcgccatggttttggtggtatcagtggagaaaaagggggtggagaaaagaggtgggaatgaaatttcgggttaagatgaatgtttttttttttgtacatgacaatgtgcatgttgtgtggggttagagttggtatttaaaccgcgagatgcccactccctcgactgacccagacgattctctcaattggtctcagcggaggaggtggcgctcccagctgtgaatggtgctatacaacctcggggttggttccacttcctccaagtccaacttgtcactggctgactcaacgagggtacttagcttcacagtccttcctccagtccttcctcagtagatggacaccagaagacaccatgccagtcgcggcttacaaagcagcagatggagtcaagaacactccaacgaatactgtgctattcagtgatcacaacacagtccaactgtcctggtctatctacagcacgcgcacttgttgcctgtggtgtacccgtacagtccgaggtatcattcgctttcttttacatcctgtcacgccctctacagaccaatctacaatcctggcaactgagaactcaatctcaatctacaatcctagctacagctcagtcgtcatcctaagctcactggaaagtcttgggcttcctcggtgacctcggtgactcctcaatgacttcctcgtcaacgtactcaaactcatacgcccactcacaggccgacggcttttttctcgtcggcccacgcgtggactgcttcgtgtcaattgttttagttcattaactatgcatctagttcttgggggggttgtagataaactttcggttcttgatgggggaccacttgaacttcttgatgtagaccgacagtccaagcatggcggaaatgacaatgatggccttgagaccaagcttctttcgctcgtcatgctcaggctcggcagcccaggtcaggaaggcagcgacatccttggccatctgggaggtggtggcgggagtgccgtcctcgtactcgacaacaccgtcgaacagagttcgggccataccaatgcctcctccggggaagtaggggttgtagttcattccgggggcgagcacgacgccggcaggaggctcgtcggggtagccggtcagcagagcaaaaatgtagtcggcacctccgtgtcgggccttggcaatgagggacagatccgggggaagagctccctggttggcggctcgggcagcctgctcgttagggtaggggccgggaatgtagtcggcgagctttccgggtcgctttcgggggttaccctcatcatcgggctcgtcgtcgtactcgagctcctcagcgaaagccttggcctcatcggtggtgtgggtcacgcccacgaggtttcgccaggcgattcggtccagagagtggcaggcggcgcagacctccttgtagacctggtagcctcgtcgcagagaggcgtggtcaaaggtggagagcatgccattctggggccaggggtactccgctgggtggagaccgtgctcagcggcggtcatggcctcagccttggttgtgtagtagtaggtggtggtggcaccggcacacacggcggaggagattccgagcagggcctgtcgaagggggattgctttgaacatctgcgttagtatgggtgtgtgatgattgttgatgggcgggttttgattggttgggacggggcaagtgacgcaagaccggggtgacaatgagacccacagacgtgacacacgtcgattctcgggccacacgccaattcgccgtcgtcgcatttcgctgcgaatgtagtttctcggtcgcaatgtcgatgctcttgttgctgctgcagttgcgttgggtgtgctgtcccacattgtggtcggcgtgtcgcactttgggatcgatccttgtcgtcatctctcctcctcaccgacacggaatcgcgccacatgcccagagtcgtggtttcacctggccttgtcgtcccagtcctcttttccttttctccctctccgtgtcacttgtctcgtctctccttgcggtaatactcagaacatgaccacctcaacaccagtgccaacaccacctggacccactggcaattgatcggtgacatggctccagtcgtcgtccgcgccccagcgccccagcgcccccattgccgatactcaccctggatatcggttacaaaagtggtgacaaaccttttgatggaagagtgtagcaggccgagttaacgtacttgggtggtaaaaaatgcgggagcaggattaagcgcacctgtgattggctgatttctaaatgtggtttgggacttgtgttgtcgtgcaaagagggtgctgccattggtctttggagtttaaacggggccaaatggggaggccgtgggtctttgtgtccccacaaatttatctatataaaccctctttgcgcccccgaatcgaccgccgccattgcccactccatcaccctcttcctctacacccattccaccctatttttcaactccactcaaacacgccaatttccaccgcctttctcccaaccaatgacaattagcgtataataaaagaaccctaacccatatgctcgccggttgcccaatatgactttagcctcgaaaccataatatggtatgatctggaggcgttggatattgtagggggacatgagactgcaacgccgaatgacacaatgtcgagcaaactaactcataatctgaattgtaacgaacgaggagttatacaggtcctaacctgtgctatacagctcccccaataaagttcattaacagctcataatctgtacaatcaaaggttcaaccgcccagtccatgcatgcatgtcctcatcgacatttactattgtacatttcatatacaatattacaatgttgctctccttaaacattgcccgttctcaggacgattactaagccgacttattgaactctatttctggttttcaagcacaggtcgcccaaaagaacaaaatataatttcagactatttcttaaacatgacgaaacttgacatttctggtaccgttcgaatcgtacatttctccccgacatcgccgcaccgttcatttggccccatctcgtgttcccgaacacctgccccatttaccattgtcaccacaaaagcttattttcgggaaaagtttatccagctgtcataatatcccaggactgtggaacccccttcaaaccagcacaacacggtatctgcggcaaatgaacaataatgcgccggccatcgtgcggtcgctggctcttttgaactcgcttcgagaccgcaccgatctgttatcgcggcagctggaagatttgacgtccaaatgctcctccgaccccgacgcgtatcctctgtcttcactgtcggttcgacgagagatatcgagcatctacaaccaactgacgatgctgcagcacaatagtgcggtgaaagctgctgacgtggcccgtttggttgagggcgaattggctaagggccgccaagctttacgcgttttggccagtggagaagatggagaccaggtggtccgagaggcggacacgagcgacacaagggacaaccacgacatacatggagtacgcgcacaaagacaggatacacaaggagctataccccaggttgcctttgaacttccaccggaggttttgaatggagacaccaatggagtgttggaggaggatgacaggggacatgttgagaaggaattgcaagcctcgtcggaacaggagttggaggaggcagaggaaacagctactgcagcagcacaatcggaacagaccaacggaagtgtgcaagaggtggatgagcctgtggagggtgttggggctgacgaggagccagttgaagaaccagttgaagaaccagttgaagaaccagttgaagaaccagttgaagaaccagttgaacaggttactgaaaccccaatcacggaggaagtgcggtcaccgaagaagaaaaagtccggcaagtcgctaaagaagaaggagaaacggtcagaggcgttacccgagtctccgccagacagcatacccgcgtctctttctgtgaattctccccccccagcagatgtgtcagctacaaccgcatcggaagaagctattcctctgattccgtcaacgcctccagacgacgaggacaagaagcagcacagcaagaattctcgacgccgcaagcgcgacaaccgcattttgcatgagctcagctcgttggatattgtcaatgtcaacgaggaggcctccaagagaaggaagagaaggaggtcagaggtagaagtggaggagaaggagagtgtgggtggggagaataagcaggaacacgaggaggaagaggaaaatgaggaggaagaggaaaataaggaggaagaggaaaataaggaggaagaggaaaataaggaggaagaggaaaatgaggaggaagaagaaaatgaggaagaagaggaggccaccgaagaaggcgaggttgaaactactcctgaagtggacactgaagctcaagatgaaacggttccctctcaatcaaaagtcccacctgtggctgatgatgtggtcgcttctcctcccgcaaaacgccgaagaacaaggtcccagagctcttccaaggaaaagcctctaaaccctattaaagaggtggttgaagaggcggtcgaggaggatactaaagaggaggacaaggaaggtcttggagaggcgaaatccacagcaaacagacgattgccaccccctacaccgcccgtggaagacgtgttttgcacgtgtcgaaagggctcgcagggccgcatgattgcgtgcgactcgccaaagtgcaaaacggagtggttccacatgaagtgcgtggggctcaaacacccacctcgaggcgactggtactgcgacgcgtgcgccaagatccgggctgaccgcaaggcccgcaagaaggagctgggtgcaaagaacaagatgtcgaaacaggctaaaaaggcccaggaggagggaaccgaagcatctcgaccgaggcggacgaggaagaggtaacttcagtgtcaccgagtgcccacaccagtagttttggccatgagaactgcttcaatactcaccgctcgcgcatcccacatatttattaccatcattataagttatattagtctagttaattttgattgaatcatctatccaatatattagtgtatataagcagagcgcaggtgccgggctgcgatgtatggtgcgattatttgcgttgtataaaacgtcgagctgcacaattactcgctcagcacatggtattactgccacattccgggctcacacatgtacaaccacgagtaggcgacaaaactgccacacacgcctatggcagagtacacggacatgatcatgagacccagaaactccatattgggtcgtccgtccagaataacagacagagctaccacgggaacaaatcccatctggtagaagaaggaggctcggtcaagcagaaactcgcgcgtggtgatgctgttgcggtggtccgacaccagccggtggttgaaccacaaaaagtacatacagaaccacgcaaacgtgtacagaatcttgaccataaactcggctgacgtgtagatgagcgggaagagcgaaatgtagccggagatggtcagggggatgaacaccagcagcagccgcttgtctcgtagcaccacaaacgtgaagggaataatgatcatcaagatggccttctcatggacatgccatccaaacaagaatgacgcgtacgcgcagtaggtgatggcacccacaaatcgcgcgtacgtgggtttcatcagaaggggccccagacccaggagctggtagaagagggtgaggaagaacgtggttgaaggagacacgttgggcaacacaccgaacgcaacgtctcccacaatgcctctagtgcctccagagacggctcctcggcccttcatgaccgtcacagccaccttgtctgcaaacgagtacagcgcccagaagttgggggcccagtaggcgtgggtgagtcctcgggagaaggggaataggcgcgacttgagattttcgagctgtccaaatgccacaaacggcccgaaacagacagtgaaagtgcccacaacaatgagaccgagcagcacggtgtctctgaagttgattctcaggcttttgaacgagtttccggggatgaccacgacacgaagaagatagacaaagtaggccggcgccaggtagaggtagatatgtttgaagcacagcaaaatggcaaacagcgctccgcagaggagcggctggccgtttcgagctgccaccatgctggcaatcatgattccgtacatgaagccgttgtactgaaagtggatatggtcgatgatgagcagtccgggagagagcacgaccgaggaggcgacggcaaaggcccgcaacttggcagtgggctttgtttttgtggcggccagctcggggtgttccgatagcgacgagtctgcgtcttctgtttcctccttagactccttgatggtcgacagctttcgggtgactccggcgtggctgcccttggtgttgaggttctgccggtcctccaccgacgagttgacgtaccactggcacgccacaaacagcagaatctccgacacaatgacggtgatgcgttggtaggcaatggtgggcatgccgtaggagcccttggccaccaggtccagcgcgccgtcctcaacgacgctagcaggacacagatgcgacagcacccattcaaagtatgcaaagaagggcggatagtcgagcgtccactcgctgacggtgtttgtgtaccattctcgcaccggcaggtggtaggtgatggccatccagttgcggtggacctcaaagtccgtggagtggtacgccgagaacagcagcagcttcagacaacagcctgccacaaagaccgacgttagggagagcggcatggtcctggaatgtgcacaatgtcgaggtttcaggtgtgtgacgttgagctgacgcgtgtactgtacccccaaactcaaatgcggtgcgtagatcggcgggctaagtaaaatgccaattggagttagttgaggcaagtggtgggaaatggttacgttttcggatgttttcggacaaaattgtgaatacttggatattagttcataaacggagtatttcattataaactgacacatttctagagttggaaacccctctgaaccaccaaaaagttgaccccctaggggaacatttgttcaacaaactcctaacaaaccccaagtaaatctacttttcctcgaccatcctccaataccgttcggcgcccacttctctcattttctttccccagcggacaaaaatgaacatggtagcacagcaggcaaatgccagtcctgccgcctccgcaaaacatcgagtgaggccctcgttcatgaaccatggagtgattccgtacgagatacagaaagacatggtgttgcgaatgagcatgacaagcaccattgagtcggaggtcatgtctctgtaggagtccaccacatagttgatggcagaaatggaagtcagcgtccctagtcccttcactagacccattccaaagactatggggaaccagtgaatgccgttggaggctcccacgccccatagaacgagagctggaggacacagaaggaggtatgctgagagaatccagagtcgatgttcgggttccgacagtcctccgtttcttctggccagcagaacccgcaacttgtcggaaatgtagccgccatagaatgaaaagacgagcaccatgacacacggagacaggtagcagagaccgaccctggaggctgggaagttgtagggagcgttggagagcacaaaggaggtggttgcgttgcaaatattgaaacaaatgagccctgttccacacatgaagcccgaaaagagaaccactgggtactttaccagggtgaagggtcgcaccaacatgggcagtagaatcgtctcttttgaaacagaaaagggggacagtttggaaaggaaggatttcttttcaaacagttgaccgacttcgacatctgtaatgaattgaacttgtttctttttctcgcctgcttctgtctcgttctcgagctcagaatctgcctgcaggctctgctccccctgtcgtctgaagttggtctcttcaaagaacagaaataggaaaaggaaacaaacggcatcgaaaatcgagccccagtagagaacccatctccagcccatactctgggtgatgaatccggcaaaaacaggggcgatatttgacgcaaacatcaacgcaaagccatagacacctatccatcgtcctcgctcgtgctcaaaccaaaggtcggacacagtgacttcgcaaagagactccacagaggcccccaaaagtccctgaataacttttgatccaatccaggttccggaagagttgattttcggaccccaaagctgaatcaaagccgtgcctagtacagaaatcaggtagacaggccgctttccatacttgacgctgagcggatggacaatgatacatcccagtccaaagagtagaaacatgtagccggttccctggttcaaagtggccagaggaagacctgtgttctgagagatgggaatgaagaccgagaagatggaggctgaaggaacacagaaggcgacacaatacaagaccatgcagaacatggacaatagtttgcgtcggggagaccagttgagaggatcatcggggtcactcgaaggggtaggagagagtataatttctgttgattcgaccaggggtactgttccggggattttcatgttgtagactgagaagaggagagaggagagaggagagaggagagaggagagaggagagaggagagagaagggagagagagaaaaaaaagagggaaaggagatacaagtccctagatataatataaaccaattgaaaatcctattgaccgttttgatacaaggctctacatatgtcattctatagtgtcatgtcagagtgctacacggtaaaccgtgactgcacctactgtttgtactgtacggtacagtaaatcaggtcccgcagaatagaacgagatcaagacttttacgatccataaaatccagtgatgaaatgacctgaatgtactcctacactttatcatatctcatctcatctagtacaagcactttccagatctacagcacactgcacgataagagaagataagagaaggctatttcgcactataacggtttgtcatgatgaggtcatgttcagtaatggggttgaaatgacaagtgctgggccgtgtttagctgagtaatggagctgttggtggaaagctcaagaggcgaatggatatttgttcttgccaaaggagatagtaaggtcagtggttgtagatatcctctgtaagttgactgtctgagcactttagaggggaaagggggacacgagacttgcgacaagtgatatatatttcaagtattcatacgatatggcatatgtcatgtctctcgtgttcaattatcattgtagataagaattggacagtgcagttgatgatgtagtataggttcagaacggactgagaatagtgagtaagatgggaacagaactggattctggtaacggcaacatgatataatatgtattctttcttagtcattcagtgagttataactcctagttgatttcattactgtactcggactgactgtatgtactgttgtacggtattgtatatactgtctgaatgcatggagtctagttgataagaccaaaactcgaattttgtgagtgaaatagtgacaaaacccgatagatgaattcttcctgcaaatgcaaacaaaacgaaccccaaattatttgtaaatcccctttagttcaccaattgcaggtgaagtaatggcgattgtactccagttacgagtatcagtattaaacttggagtcaagtacgagcgtacctgtattgagcttgtgtgtctgtgtactgtagcttgttacaagtaccacaacctcaaatacttataggagttatacctaccaaaaatcaccacaacatgtactcacgataccatttcggatacctcctagattacaatacccccaccaagatacccgcgacagtggcaccggccgagaccgaaatgccctccaagtttctgcctatggacggaaagggagaagagtactttgagacgtcgacttcacctgtggttcttcagcttgaaaagtcgcgacgaaacctcgacaagggcgcaattagccccaaagtccacctcaacacggcgctgactctgttttccgagctggatctgccgctccacagaaaggccagtgctctgctccgatacctgtctgccgacgtgctcgaaaatctggcgaaaagcagcgatgcctccaacgttttcagcaagtttggttgctactaccaggcccacgattgggtggctttgatgaaagtgctccaaaatgaaaaggactttttgctgacgtcgtcttccgtgtccggctataccaacaacgagaaccagtactacaccgaccctcagttggttctgactcccgattccgatcgaaagcctccagtgggatctccatccacctcccagtcccagaccccggtacacaaacgcaaacgcacgcgcaagcccgcctcggagatccccgtgtgtccttctctgaccaatttgtgatacgcctgaaagatgcaggttcgtagcttgaagtagaaacaggcagataatgtaatggatgggagtgccagcaggtgtaagaggggtcaaagtgtcacattttggaattacgatatggccctgtgcagtacatacagtacatacggccctgtacaagtatcctctttgagttgtccaaggcacataatacggtacatactgtactgggggttatcttggagcacgagtgattggattgtacgatactgcacgacaacttgtacgaggacagtacagtactacacgtgtgcgagtactgtacgtaccgtaccgtagctgtacaagtaacgcatgacccactctcattgtatatgtcgatagttatctagctattgtatctgaccaccttcatctagcccgttgaagctcgttatagagcacgtgattgagcctggttgcaatttttgcatggctaccctcggctaccatcttccttttagttgtgcgagtttttctgactgctactgccttttctgacttgtctgcgagttgcctgaaatttcccagttttccggatattgcatttccctaaaatctccattttcgttgttcaccaaaagtgcaagtttaacggcagtcggggtcttcgagattgcatggcagcagcacagtgtactggtgcgctgtatgacacgagccgagttgcggccgaaattaatttgcgcgtctttctgtgagcaacttgtgggtggcgatccgcccaaattgggccgtttgagtggcaagtagaccctccttccgccgaagttaacgtgttaaaaatagccccctggtggagcgaacgtgtagtattaacgttgtactttggagtgcgactagggtacgagtacgagtgggtgtgagtattgtacccagtacaagtagtacgtagggctgtccacagctatcggtacaagtgttgaccggattgtcgcgggagagggtttctacggagtatttaatggtttttctttccttttctttcttttctttcttttctttcctttccttttctttccatttcttttcttatccagttggtttcgattttggcaacttattttacgttgtttcaccagaccgaactttgcactcttgtacgataatcactcgtactgaaagtattcatactgccgacgattgggtcaaaaaatctgcaaaaaaccgatttccaacgacgtactcgcactttccaggttcaatttccaattttagccgccaatttccattttctagccacccgcaacccttgggcacctccattcaaaccatctcctggtgaacctacattgtagggagtctggataacctcgtgcatttgagaggcacggttagacacgacggccaaacaagattggtttgacacgacagccagacagtcccagctacaaccgactatcatggcgaaaaaacgaaagaacaagaccggcaaggtccaggatcgggccgccgacgaccagccggaggacgcggttgcagatcagcacgtggacaagacggaagactcggaaccagacaatcaggagcacccagccacgggcccaaatgacgagatccaggacccggcgggcgacaaggtggaagacacggtggacaacgtggaaaacgcggacgacacggacaaaccggacctggatgaatcagacaaatcagtccagacgggatcacaagactcacgcaactcggaaaagacagatcaaaagaccgaatcaaccgccgaatcaaccgaatcaaccgaatcgactgaatcgaccgttccgaacaaacccaatctcttttctctttctgacgaagacgattccgaagacgagccgtcggagtcgtcggagccgtcagagccggtcaaccctgtacctgtcgagactgtcgagtctcccgtcaagacccaacctgagaacaagggctcgtctctcaatgactcttctatcaagagctcttctaccaaaagctcttcgtctctcaaggactcgtctatcaaggacagatcggaggtgacagttccctccggcgagtcggactcttcagattcggaaatggagttccccaaggtggtttccgaacctcctagaccgtccactcccaataccacatctcacgctgaagatccagatcagacacccgtggctcggggcggccagagaagcccccatgtgaccatggactcgactgcatccctgacaacccccacggactacgagcgtgtgtaccgacgtcgaaataccgccaacagcacgcggtctcggatgaccgtgcgagtggacactgccgatctgcaatcgcagtcgcccacacccagcaacggcatttccatcgactcgtttctggagcagaaggagctgtctttccggctggtcacctggaatgtgcacaaccgggcccctcctgttattgaggacgagcatctcgattcgctatttttgccccagagcgacattactgttcttgcgttgcaggaggctgatccggtcagtggtcttgtaagtactgctcagactctcaatggatggaaggcggcggtgctggagaccctcgaaaaggccaatgaggaaaatcttcagaaggacgagactgtagtcaccgccgaggaggttgaagaggagacggataatgataagacggagaatgataagacggagaacgataagactgagaagagcgacaagtcggagtcaagtgacaagtctgacaagaaagacaagaaagacaagtccgagaagactgacaaagctccaaagactgagactcataaaaagtccgcaccctccgacacagaagaatctggatacgaatcgtcggcctctggatacgagtcgtcggcctccaacaatcacgcctactacgacccctactccaactatgttgtttcgtccaaccagctgattggtctgctgatcattgtgattgcccgcaagtcgctcatgagccagatttccgacgttcgagtcaagtcagctggaacaggtcttctgggagtgtggggaaacaagggagctgttcttgtggaaatgcatattggccgagaagccaccagcacgcagtcttccaagggcgacttctttgtgcccggaacacgagtctgtttcctcaactgtcatctttcagccggagacaacaacgttgttcggcgacgatgggagattgaccagatgtaccgacgcctggagcttcctgggcgtcccgaatggtatgccaaggtcaaggaaaacaaggacagcaacagcagcactgcctctctggctactgatgatgccaggtacgccgattacaatgcatcaagcgagtttctgggcaatgccacagagtcttccgagagcgatgctgacgagaatgaaagtcttcgtggacctttcagtgcagctaccactatcaccgaaatgtctcccaatctgaacggacgaggattcaacgataccgaaagtgtggtttcagctgattctcgtgcgggaggcgtctttgactggtctagtgatgccgctgccgccggtgcccagcgacctgctcgaccacatgaaaactccaacctcagtgtggtcagtgaagctgtttctgccagctcacctcgaggcgaccctcgaaccatcatcttcttcctcggagatctcaactaccgagtggacaagactcacgaggaggccctggagatgatcgagaagaacgatttcgccggcttgctggctcacgaccagcttctcaaagataccagagacggccgtgttctcgctggtctcaatgagtaccccatcaacttccctcccacatacaagtacgttgaggataccgtttccgagctggacactctacgaactccttcctacactgaccgaattctctcgcgagcctggggaggctgtgagcttgttcagaagggataccacagtcatatggagtacactgtcagtgatcacaagcctgtttcggccgagttttcgctatctctgcctctgattgactttgacaagcgcgctcagattgtcaacaactatctcaagtctgttggtgttcaggagaacctcgaccggcctgccgtcactgtttcccccatgagcctccgtgtccagcttgccgtgttgaccacccaaactgttcctctggtgatccacaatactggtcacactacagctcactgggagatttcccagacctctggattcgacgatgatagcaaggacaagaaggactcgtcgcccagtatcaccctttccagcaccacgggccagcttcttccgggtgaccaggaagttgttgaggtcaccttctcggctgccattggagcgccctcttgcgactcgtttgcaattgtgcatgtcaaggactccaaggacatttttgtcgacactggctacgatgtgatgccttcatgtttcggctcagacctcgattacctgtccagattgcctaacggagctcgaaacggtctgtcagacggcggaaaagtggtcagcaacatgcctcaggagatttggaagtgtgtggattacctgtggtctgttgtcgatcgggacggagaaggaggaggcgacggagacagatctgctcgtcccagtatcgagaagcctggaacagctgctgtgtctcgagagtctcccaaatcacctttggttggcctcttcacgtcccctggtgacccgcatctggagatggatattcgagattggcttgataccgggtctccctttaacgtggagactcttaacgacaaccctctgggtccacagtctgtggcttctcagctacatttgctgttggcttctttgtcacagagaatcattccagagtatgcctatctctctgtgcctgaaaaaaccatcgcagcaggcacgggaagccgaattccgtttatgggaggaggagtggacaatactgcggacgtggctgcccatattctggaggctgtgcccaacgtgaatgccaacgtgatgatttacatctgctccttcatccgtctgttggtagacagaaaggccatgactctcaagacggcactggacgtgtttgcacctttgctgatggacagtcccaaacaaggaggcgtgtccaaggtgtggaagaagagtccaatcagttctgcaaagctcctgcagcacatgatcgatacttattaggtggttatagaaatagacgagttgttttgactggtgtaattaggcctaacagtccagagttgacatatgttctactctgtggagaaggaaacgattcctggaggtgttcatccatacgaaccatactcctcatagcatcgaactcggtcaatgcacgcggaaatcatcataaatgccattaaaccgctatctatctatgtgctctattttaccctgatcagctctttcgatccaacaatcctccagtgtgcaatgaggcgtagttcagctttttgcccacaatcttctcgtaggccttttctcctcctcgaacaatccacgatccacagaccacaaagccgccgagaatcgacagcagtttgacgacaaacacggtcaacgtctcgcgcgagtcctggatcttgagagtcacaggctcgtacttgtaatggaagaagatggccggtcgggtgacaaagtgctcctgcagattggtggtttgttttttgacggcatactggtaggtgtggatcttctttctgccggagctgtattccacaggaacggccgacaggaaatactggtacgacatgagaggctcgtcggtgacggtgctcactccatccagaggattaagcacctttgggaagtaatctccgaacgacagttcatggatggcatgagtcaagttgagaccatcggaggccttcatggggttgatgaagtactgattgtcgggcagattgaagatctggagcgctccttcgacgtggttgatgggcaccgagccggagattcgacagtgggggtcggtagaatgcgagcccactcgcgtgtgtttgaatttgctctttttcagcgtcttactgttcatctcgtacgccttgtggctgtggatctcgtgttgcattcggtctgtgccaaagtcatatgtcaggccctgcatattgagcagctcgtgtgcgaaaaacgtgtcttcggagtagtcttgagcaatcaccttgatgctcttgcacggcattgccactgtcacgtccacattgagctggatggtttctgccaggtccttggtcactgtgtaaatgtgctcctcgtggccgttggagtatcctcgcagctcggagcagagaaagtagaaacacaggacgccaatcaccagggtggcgagtccgcctcgcgtcgactgtcgcttgtacgcggtgttgacttttggaaacgcgtcaaacgacctcaaggtcgagctttcagacatgttgtggtgctggatcgttttgttagtgatgaggtggctttggccatatgctctgacactacatagacatgcctctcagatgcatgatttagtttatgtcagagcagtgaaatgtttcacattgtcactccaggataggatttgtccgcgtttttctggaagcgacgtattaacaggaagtaacctagccccaaagatactcttgattatccggcgcaatatcccgtttttaacagacccttgacctcctcttaaccgaacggcaacgctcacaaaaccgtccactaatttgacaaaactgcacaatttttattgattaatttaaaattattagttgacgcttctcgatagatcaaccgaagcacaaccaatctgagtggagacacctacagctagagagagacctacgatacaatcacgatacagcccaactacgagttagtgtcaaatacaaacaatcaactctcttcatcttccctccaatcaatcgtcagacttctgactctcccgtgtatacgaacacacgcactcccggacgtgtttggtgtaggcgtccggagagtagctcttctggcaaatgggacattcgtaggtgatggtcgaggcggctccggtcatggtgtgttttggttgtagatattgatggtgttgcaagaagaaagaagtaaaagagtcaaacagcagttattacaaatactcgcctcatatcgtacatgccgaggcgttcatttgggccacatatttccagtgcggggcggttgctcaacaagcgtcgaagctacaagatcaagtgtcaatgtcgaatagtacatacagtacagtaagcaagtggcttgatatgtagaaacaaagatcttacagagatgaaccgaattggacttccgtgacgatacgacatgattcagctctctgtttcatctccatgttctgaatcatagattgctgtatacagtatcgtcatggtgccccgaacatgccacaagaagttacccggatgtatcgtacgatactcatggtatggtaaggtatggtggtatcgtacaatgcgtaatctaggaaaaagaacaaaggaaaaaatgacagatatgtgccgcggtttctccatcaataaaaaaattggtccctagcaggatcgaactgctgatcttcgcgttgcaaagaggctaatttcttattagcacgacgccttaaccaactgggccaagggaccgcgaatttttaacacccaaccttgtttttccaatatctggtcaaatatgaaaaatcgatctggcgaaaaaaaacctaaaactcgtccaaaacccgttctagagacggtaaaaaggcctgcaacagttcacccacgcctcccagatgtcaaaaatctactttaaatcacacctgagcaccagatatccccacttgacactcctcctacagacacaaacaatcattctaagcggcgttcagaaggagaatggctactatgcaacagatacagtaggcggagcaactctctgacccctgccattccccgccgactagagtcgatattttggcttctttttgctccacttggctgccgttgagagtctgatgttaagagtgtggggtagagagcagcgcattgctttcggctaaatctgataaaaaaaagatggtagtatcactgacgttgcatttctgacaaaattcagtgacaagtgtcctcggtgatccgggtacagtttgcgcagaggactcatagtgcatgttcaagttctgtacataccaacgttcatctcagacagtagagaagatgctcacgaaatcctagaaaactgaccacgaaaactcgtctatgaaactcgtttggaaacatctgatttctttttcttttctcaacaatattcaagaccaacggctacaacaacatccctatccctatccctgcccttggttggggtggctgctacggtttgacagctgtcagcgccaagacaaggaaaagttttcatatcgcgaaggtcaggagatatggcgacccatgtcagctaaaggcgaccagctccggggcaactcggtcagtttcggaaaaattgtctcttggtgtgcctgagctacttgtagccaattcggaatcttccgcggctagtcttaaccgacaggtacaaggctaggcactagggaggtctcaaaggagagtgacaaggatgacaaggagatactgtaagactggggaagtggaagaaatatcgaatcccctttcatcgagaaccaacatgtgctttggccatttcatcgtaccgacccacccaaagtggatactcaaccgagcgcatttagatactcttggcattcggctattttgtaaatcagacgtcatttaccccagagaaaaaagtgacagttggggggaaaacggtgggcaaatggacttcagcttttgaacagcttcgcgtactacccggagacaaaagttgttctttatttcaggctctgctcctctcaacgcaagctccctcgtttgaaccggaaaaacggaaaaaccacacgacacaggggtgtcaaacgtcaccaacagtggagtcttgtcatgccaaccccacatagtttcgtttaatctgagtttaagactaccccgcaagcgcggctacgtgttgcgagtccgccgacgatgatgagcttgcaagttggagcttaggagtgataggaatagagggtgtatcggggcgcatgttgatctagagctgtttgagctcaagaaagcccctaaatgggcaccgtagcaagctactttctagtccaagttcctacatcaactgttcaacgtgtttcttctgtcatctttagcagacgacgtgtggtcttggcacgcccagccttggaatctcggagttttgtatataaatcagcttggattcagcccagttcaaacaataatgaccaccatgaaaccaaaagaaacagcaactacacatgtggagaacattagtccaaacacccccgacgaagaggtggaaaaggacatgtacacagtggatgaccggcccgagtctctggcgtcgttgactgaagaggaaatgctggctgttgagaagaagtttgtgcgccgaatcgacatccgaatgctgcccatgctcatgctcatctacattctcaactacctggacagaaacaacattgctaccgctcgactgggaggtctggaggccgagctgggtctcacttccatccagtaccagacgtgtgtatccattctgtttgttggttacattcttatgcagattcccagtaacatgattgtttccaagctgggcaagccaggcttgtatctgaccagttgcatgttcatctggggtctcatttccgctctcaccgccaccgtcaataacttcagcggtctggtggtgtgtcggttcttcctgggtttcatcgaggccgtgtacttccccggctgtctgttcctgctgtcgtcgtggtacacccgaaaagagctggctcttcgaacctctattctgtactgcggctcgctcatttccggtgccttttccggactgctcggcgccgctatcatggagaacatgaatggcttgcgaggtatctctggatggaaatggctctttatcatcgagggctccttcaccgttttggtcgtgccctttgcctggtggattctgcccgacttccccagcaccacccgatggctcagccagcaggagaaggacattgccatgtaccgactgcaacgagaggtaggaaaggccgacgtggactctgaactcagcggcctggagtttgtcaagaagaacttgggactcgtcatcaaggaccccaaggtgtggctggtagctggagtcaacttcttcaacgttgccgccgccggagtcaccaacttcttcccttcggtcgtccagaccctcaacttctcccgaacaatgaccctggtgctcacctgtcccccttaccttctagccaccattttggttcctcttaactcgtggcacgcagacaagaccggcgagcgactctaccacatcattgtgcccttttccgtcaccattgccagctttgtcattgccgctgccaccctcaacaccgcagcccggtactttgccatgtgcatcatgatctcgtccatctacatgggatttgtcgtcactctcacctggatgagtaacaccattcctcgaccggccgctaagcgaggagtcgccattgcgctcatgaactgtctcagtaacaccacctccatctggaacgcctacctgtaccccaagagtgccgccccacgatacgctcctgccatggctgccaactcgggctttttgctcgtggccattggatgcgcagttatgctgtcgctcaagctgagaaagatcaacaagaagctcgacaagggtgaatacaacctgatgaaggagttcggactggacgaggaggatcccgaaggagtggtcgccactgcgggatacagatatgtttattaggtagcagagttagtataattaaaatatttcatgaacaatatctggtcacgtgttaatttgccataaagtgacaaaaattgaatttatggaagaaaaaagaggtcccaccgagattcgaactcgggaccttaagatttgcaatctcacgcgctaccgctgtgccataggaccgtatatatgaagttttaggtaattatctttgttaacaccacgactgcttagtcatccagaatcattagaataaaaaaaatccttagaataaaacaaaaaaacgccttgattcacaaccacgagaccacgacaaggacaagaacaagatgaagcgtcgacgagccaacttacacgcgcctcgtagctcacaccgaaacgatgtataagtgtatttattgaacgccaataacccggcttactacaattagctgcaatgaatcattagaaaaaaaataaaaaataaaacgcaccaaaaaaccgcgaaaaaaaccacgattcactcaattccacagtgatgcggaccttgactgttgattttatcagtcatatctactgaagataccctggtatgccctgataatctatagtttacaccatattccaattggtcaaacctccaaccttggtgtctttccttagcctggaagtcgaactggtatatgctgaatcattactggttgatccaagctgtttcattcaaattcaccttcaaaagtcccaatgatgtttcgtagccatagtagagctatcatacatataccgcacttgtatgtatacaacacgttggaacttcagccaatacaagctgttacagtaggtgattacattcatataatccccgacagttcaaaattgaaagatagacatagtcagaatacccaatgatcgttaaatacctgttctgctaactgatccttataactccagacgtgacagatagtccagacggtcagataatagccttgaaactgaaatttaagggctactgggtactaggtacttatgagtaaccagtacttatgagtaaccggtgcttgtcttactatagtatttgcaactgctagcccatcttgtatgtgttcctcactttataccgaaaccgatttagttacggatacaggagtcaggaacatgaattcaagcaactgattggagaggtgagaatgctcggtcattgtggtggaaactaaacgaaaatctatggtaaagtcattccctacgacgatatcagaaatttcaccgttcgcaggtagaagtttgaggaaacaaaacaatcagtctctgatatctcatcgacatttaaaccttaccaatccctttctcgtctgtttatcttgggtctagacaactattttgtcctgtcttacccgtagaacagcattaagagaattactgcccgatcccttcagaagactacccgattgcttcctcttcttgaaaaactctagaatgaccttagagactgttgaacaagcacattggagtccgattcgggttttcaaaagagtgtatgaaaattgtgctcccggtattactcctgtttctttttggcgatctcggagatctattttttattctaaacaaggctgttttagtcagcacccttcacatggtccatgtcaaaacgtcccgagattccacaaccggcctggctagctcaatcggtagagcgtgagactcttattcaaagcaatctcaaggctgtgggttcaagccccacgtcgggctttctttttggcagttcatatactgggtattttttttgtcttactaagatgtacaataggcaatgttaagaccagtgcaaagacatgttcaaagacgtgacgctcgagctattatgatttatttcggttttcttgtctgccgacttgagtatatcgactggctgccgtttcacttgatgacacgctcacaacaccgtcaatactcgtacctaatgtctgtctttagctgctcaaatttttttcagcgataacaactttgataagaaccttaacataaaatatttcaatgtgtattgttgggtgatttgtcgtaaaacttgcgtggaaaagatttatttagagcgcttttacaattaatcgaaccaaaaacaatatctccactcatagacagctctattccagtaccaatatgaatctccaggcattggaaagttcgattttaagtttaacaacatcataacctgaatactctacatacatgcaaattgtctacttgtagaaacaggcaaaggaactaagagtgtcattttctagcaagagagacaaaaatggacgacaccggaatcgaaccggggacctcgcgcatgctaagcgcatgtgataaccaactacaccagacgcccaaagatgagtttcaggttgacgactgcagacttaagcataaaaaagtttttgataaaattaaacttaattaaacttaaaatatttttttctgcattaaaaaaaaattgaaaaactgagaatggaggagtctagacaagggcgagaaagtccagctgaaacagagtaatgttgtgtattttcattgttaaagcctagtgacttacggtttttctgttaacccaggttttctctaccgtcacttgttttcttgttactgttttcgtctgacctgaatacttcgtcaacttccattggaatcttactttatattgttaaacgaaaaccgccaaggtcaatgatcaatgggcgtaacgacgtgagtgaaattaaatgttcgaattctcttgaatgcgcatatacgagtcggaccctgggatttatctgaatccctagatcagtgaatgcaccttgtgatgactaatgtgtaagaacttgactagagtaacaaagggaagccactaatggagtattaacggcgattaggagttcacttgggcgttgaagtctatatgggactcattagaagtggtttcgtgtctttatgttgttgtttaacgacagctaattaccctggtattccccaaattaatacattgatagaaataaatacttgtgctgtaaagtgtacccacacatgttcccagttaatcactgatatcgatccagatggcatctgacaacgaagaatcagaagacactgcgagtttactcttctccttggaattacgcttgttgccctttttagaagacctaggaggcggtggaggaggtggcgggatctcgccaggaatgcctttcttcagacgctcaaacatactcattttggcagtggaaggagcgcgtttggagatgcccttcttggatacaatcttcttagtgacgtcgggtcgctttttgacgccgtcaggacgcttctgagcgtcttcgatatgccttcccagagtctccgctcgctttccgctgctctcgtccacactcttcctcttcttcctttgtccttcggtagacttctcggacagcttgctggatctgacagacttatcattggcctcattgtcagtcgcagagttcatttctgtcttgataggctgcatggttttctgcttgtctcgcaactggcgcatcttctcagctcgctccttcatagacgaccctgtagaagccgaagcagtgtcggtagcactggaagcatattcagcagtagtagcctgcggataagctgactgggaaaaggcgtcagatgccactggagttgtttcttgttcgcgaccagactgcgatccactctcttcatcgtccttgttgccgttcagacgatggattatggctgcggcaacatcgcgagcctgatttgtcttcttgatcctattagaaagcttgctgctagcctcttgcacagactttgcagtctcagcaactccccgaagctcagcctcggcctcctgctccttcctttgttgttcaacctctttcctccgccgttctaccacccgctgctccagctgccgtgccgcttcagcctcagcctcttcctctctctgtctctcggcttcggcctgcagacgcgctttcctagcagcctcctcaacggtagcacgcttcctttcagcagcaactcgggcgtgaataagttcgtgtgcagcttcccgggcagcatgttcatccgcaagttgggacttggcacgggcctgagctttctgagcagccttacgacgtccttgcacgtctcgctgtaccatctcccgtcgctcacgttcttctcgctccaaatgttcctcttcggctctttccctgttcctttcgagagtgcgctcatccaactgagagaagtgaggacgaggaggtggtgcagtaggagcgatagcgggagagttctctgtggtagcgaacgacgccgtgatagagtcagagatacgcttctcctgctccaaaagctgctggcgctgtttacgggcctcgtttcgtcgcatatgcatgtctgaggcggaagtcaccactggtgaggcagataccttagaagtacggtcagaagcagctgcttgagaggcaggatcggaagcagccggctcagaaacacgaccatgtgcagcagctgtagaggcttgatcggatgctgtcacttgcttggccccagagacaggctcagagccgcttctagcacggtcagctgtgggggtctccacagtgacgggagccagggcgggttcaggtgacaggttgttcaactcctggttcgcagctgcaggaagagtgggcgcggccttctcaacgggagagggtacttccacgtacccaccagtggcatttgcttgagaaagggcacccacagggactgaaggaattgccggagtggaagcagggactgtcacgttttcagcagcagcggacgtcaaggtaggggcaggagccgagggagactgggggtgcacacactgaactaaaggagaagacacggtcggagactgatgagtatgagtgtagacaagcagaggcgatgaaccccgtgctgcagggctcacagggcctcgtagttgtggggcatgtaccgaaggatgcaactgggtaacaggattaacaggcgaggactgtgcgactgagaaggtctgaaccacgggtgaagcctgagcagagttaccagcgtcgattattgcgctcggatttgagatactcgtttgagtggtaatttcgggagaagccttggcagaactgtttgcgttgtcacacgtgtggactggctcactgcctcccacatcgtcgtcgtcaaacccaaactcccacttgtcctcggagcctgccaacaagacacacttgccatccatgactgcaaaccgagcagtgatcttggagttgggatttacacacgtcaatgtgggaaactttctcaactcgctcaacatacgcgagatgggcggaggaacaaacccgttctcggagttaaacataatattattagaatgctcgcttcggcgtcttttcgtcaagtgttcttcttcaaaaggataggcgcgcttttctggagtaaccacagcgttgttagcgttagtggcgtggttgttgttgttgttgttgttgttgccagaaagagatagggcggattcaactcgattctgaagagagttgacagtatgggtgacctctgcacccatctggttcaacatgctgtggagctgatctatccggttgccgagtttgatgcagtgctgatcagcggcttcctgacggggctcaagtgaaaccaaagcgcctagcttgaatttgagactagcgagctccttctctaccgcctgcagtcgtttatccatcaagccataaatatttgtgtgctttcgcgacacgtccaccatccggttccagttttgctgagtgattccaaacagttgttgttgctgaggtgcgaggtgtctcgcaggattagttcgagaatgtgtgctattggcaatgttttggggtgacgcaatcgaattaggtgaatagctgtaaataaaccagtggggagaaccctggaacgcaggcgtgatagggataagattggtggagatggaatcaaccgagcccgacaactgcgagggatcgagagtgatgccatacatgtcagcaggcatgtagtgagtggggaagagcctctggacccattctcgaaattgcgaaaccgattggaaatagggaaccacctgctgcgattgggtaattttcgataggcccagctttcgatcggcccttagatacggaatgcagagaaaaagcgtcttgtagccgcaattgttgctcgcatttgacgtcgtttggaactgttgtgtcggctgtgccggctgtgtcggctgtgccggctgtatcgactgagtctgttgtgtcggtggcgtctgctttggcggctgtgtctgctgtggctgctgtggctgctgtggctgctgtggctgctgtggctgctgtggctgctgtatctgctgtgtctgctgtgtctgctgaggctgctgtgtctgctgtgtctgctgaggctggctgacttgggggttggcctgaaacgtcaacagcgagtttccaatgccattgatggcctggaatcccgcctggatggcttctgttggtttagaatatgaggattccgttgttacaggctgaggagcaactatttcggccatagtggcggctgtagaagcagctggtgcactgtcactgggccgcacaacaggcgaccgcacaatgggactttcactctgttggggcgtagacgatgcgatcgtctctacagctggaggaatcggactgagcagggacactggcgggcttggattgttggagaagctggtggccggttccgcagtcgtcgtgttgggcggctctgtagtgcttccagcggtcgacacagcattgtcgcgagctgtgcttcttgtcgttgaactgccatctgcagtggtttctggttttgaggccgcggttgtatctgtggtatcggctgtggttggctctgtggtagttgtatttgtgatgctttccgtgctggtatcggcgttcaaataggtgatgccatcgcgattgcggattcccaggggctccagaagattgccccgcacatccacaatcatctcgtcgggaatctcaatgactcgcaggctttcagaccgcatgaacgcctggctctgacttgttagaccgcagattgatagcacggaaaatgtgcgcgttagccctgattgcgacacgcgatatcgcttagtagtgtctaacttggcgttgagctgcttgcaccagtccaaaaattcatcgggacttcgccatccggtggggacatgtacccatatgctgccagtctcggggtactgccattctgtttcggatacgcgtttcggctcgtgaaacacaatgtttttgcgcatcgccatggctgagagcaaagacggcctgttccaatgacttggacaaaatagttgtctgatgctaataacttaggatttaggtctccatgataagcttagtcagcgccaaagtgaaccggatattacgaggtcctggcgggagttaggggcaatcacgacacaaatttgtgcctttatgagcacttcggggacagtagaagtagcacttataccattcacgtgcaaattaccgaggtaacagcgggtgtttagggtttagtggattccccataaggtgcagtcctagcacattattatatatgctgttcctgaaagtgcttcagggtacatataagactgacgtttcaaagaggggttcttttagcatgcgtgtcgagagattgacagtgtgtggttgaatgtgctgaagtacgagtacgagtacaagtactcttccgttctttgttatctacttacacctacagtctgtacatactgtaattatatattgtaactatatactgtaactatatactgtaactatatactgtaactatatactgtaactatatacaacaacagtttttgaatacttcccagccctagacaacagactgtgtttggccgacgtgcacatcaaaggcaccgacagacacctatcgctgatcaacgtatacgcaccaaacgagcagggagcctcccccttcactaaccggcagttctaccagtcactagacgactatctacgcctccatccctgccaataccccctgatagcggcaggcgattggaacgcggtcgcctccaacgacggcaagattggcgaaaaagtgacgactcaccttaaggacttcttagctaactgggacttactagacacctacactctaatcagcaaacacagaaaaggcctttacactcacaccaacaacagccgcggagctggcaggcgcctggatcagctgcacatctcttcgacactctcacagtggatcaaatccacacaactggtaaccaacaagcagggtcacaacatcacgaagtcctctcaccacgcggtccaattcgtctttaactttggcaacctcacccagcgacaagacagaggcccaggcacctggaggatgccctggtgggtttttgatacagagtacattgcttggctcaagttccacgtcaaatccattctgaagcgatatggtcctttgaagcccagcctgaagctgcaatgcctgaaagaaaacattaaggtcaccatccaacaggaagccaaaaaccgcgcacttcgagattccaaccacccagacaacagacgccgcgaggccctcatggcaacagcctcagactggcaagcctacccagctaacgagccatacccgatgctccatgctcgggtcgaacaatccaagcaacagatggagatccactccctacggaaccaccaaggccgagtgaagaccgacacctcctctctctgcgacatctcagctcgatactttgacaacatcttcgacagagctgccgatatcaacgacaccgacgacagcgcctttttagacctcttccccgaagaaacccggagggtgaatacagctaacccaagcctggactcgtcttttaccaaggaggagatcttcgataccatcaaggcgtctacgcacaacagcgcgccagggccagacggcatcccgtacaggttctaccgcgactgctgggatgagctgggggacttgatgacggacgtctacaacgaagctggagccgactcgcccatcagcaccgaacgcaacaccgctatcatcaaactactgtacaagtcgggagatcaggccgacatctccaactacaggcctatttctttgatcaacacagaggtgaagatctacacacagctcattaacaaagccatccagaacattcttccggacagcattcacggcgcccaaaacggtttcgtaccgggtcgacacatcactaacaatctcgacaccatggatcatttttgcaacgcctactcccagctgaacatgggttgggtcgtaggatcactggacttccggaaagcctacgacactatcagccagagttgggtgataaagacgcttcgaaatgtgggtgtctcggaactgatgatcaaccgtatcctagctgtacaacagaacgcagtaacgagaatcaacatcagaggtgtcctatctcgcccagtccgcatcaagatcggagtgagacaaggatgccctctctctccaaccctcttcatcatcgcagtagacgcacttgtgcgtcgtctggaccgagagatgtttggactggccccaggcctgccactatcccaccaccacaccactgggcacaggccgccacaaccccctactcacccggaggcagtggcagctggacacatgaaggtgtcggctttcgcggacgacatagcggtgttcctcaacaacatccaggacgtggccacggttggtagagtgctctgcctcttccaacgggtctcaggcctcacactaaacccgtcaaagacggtgcttcagaagatcggcccccccgattgttttgttccactaacctttattgacgcagaatggcagcgaacaattgacgccacctggccaaccgacaacaacacacgacaggccccgacgctccggacatctgacaacattttccggtacctcggagtacacttcggaaatcgcgaaaggttggacacgcactacgctcagatcaaggaggacctcaaggagtcgctgcgacgcctttcactatggggtctcccctattacagcaaggcgtggatgatcaacatctacttcttctcgaaactgaatttccttggaccctacgtcagccagatcgacaacaccttcatccgagagctgaacgaactagcgtgcgacaagatcaacaaattatcacccgacaaaacacgcaaaaccttcagcaatggtttcatccaaactccggtaggcaggggaggactgaacctgcgggacatgggacgtttcatggtgtgcctgaaggccgctcgggcttacaggttcttccatggctcatcgccggccctttgggactgcaccttccagttctacagcagaactcacagtctcacacaggaaaagccacaccagcgcgtcgactgccgctttccgacaggccaagcttggggctacgcagcctcccccaccatgcgagacgcaatcagagcttctttcgagctcaacaagcccctcaccgcggaacatgccaaccctcgagaagatcacgagccctctacaacagacacagttaatcacagaatctgggaacgaaaccaggtgaacgtgagagcagcagaatccttccgggaagcgcacgtcgacatcgcagccgcgagacgataccatccggtcagaatggtgtccacagcggaaatcgaccacctccggtggagcatgggaccacttactctaaagaacttcatgtttcacaagacctcgtctcccgacttgccaaacttcccacacacacttgcacgaccgaagaagtggactcaacgaagcgactacgggggcatcgctgacgacatggtctggcaggaggtaatgcatgaccttcgaaaacactacatcgccgacgccaacaaagcacaagttcttcacctcatgcggatatctcgacttccgctcgtgaaatggagataccctgacgaccacgttttcaccaagaagaatccaggatgcgggctctgtgataaggccatcattcaggatctgcacgagcatatcttctgcaagtgcgaagttcttctttccatgttgaccaggatgaagattccgtcagtggactctctaaaggactggatctttaccgagtcgaaatgtggagtattcccctctttcccagggcatgtgaacagtgacgccccccggaaacatcaacaagtcaagacacgcaaatatctgcgggaattggcttatgggatctggaagatggagagatccctccggtactcaggggacgacgccaccctgggacatgtccaacagggtttgcttcaattcctgaaggaagcccagatgtgtttctacgatggacaaccgccagcacttcacgatgagcgagagtagcgacagtagcaagcgtaaaaggcggccgaggccaccgacagaacagcgtagcagggcgcgtagtcaccacaggggacgcagaaccaaaccaatgacgaagaagaaccacaaggagacgttttcaaaggcaatgcaaacgaagagggcaatggaaggattgagattagagaactggagactggagtggcgttttcccgatgaacgaacaaacacgcgaagctatgtggaccaacatacaacacggactgaaccaggtttttttatgatttttttactggaaataggtacgtgccaagttggaccatgacactaaacgtgtttaattagtaatattcgtgtaagcgtacattcatttttttttttagaataacctttgaaatgcaaaggttattctttcacagcaaagttataattaaatgaatgtatatgcagaaaaaaaaaacacgcgaagttatgtggacctacatacaacacggactgaaccaggtttttttatgatttttttactggaaataggtacgtgccaagttggaccatgacactaaacgtgtttaattagtaatattcgtgtaagtgtacattcatttcaaaggttattctttcacagcaaagttataattaaatgaatgtatatgcagaaagaaaaaaaatactgtaactatatactgtaaggaattatatactgtaggcataaggaataaattattgtaaattaattgtactgtacttgtatatttgaacttgagctgttagagtgactacaagaatgtaaagtatctgttcactgatctctctctaatggtcacggtatagtaaatgctcaagaaacagtctcctacttgtacgacgactacttgtaacaaaacggcgcttatatcatggtcatattttactccacttaaacacttcttcttaaccaccacaatcactgatacccacaatcgtccggataccccaaaacatcacccataccttctaatgtccagtgagagcgtttccaaagtcgatggaatagtcgacaaattgaaccatgtgctcgatatgctcacaacagagctccctcgtcttcagcaggagaacaacaccctcaacgcggaactgtctcagctcagagccaactacaaccatcttcagtccattacttacgtcgagatctgtgacctcaagtccggtcttctcgcccttctcactgagaacaattgtctcaaagatgaggttgctactctcagaatccatcgcggtgaggcctcaacccagggctcaagtactggcacagacattagcgatggttacgagccagagtaccactgtggataaaaaagtggtattgacgccctttctcaaatactgggaagtcagaagcgtctagataccaacgcgcgctacaagtacaagtctacagaactgaaagggtctcatctaacggaagtataaatttcaccctctctgctgaggattttgaaatgtggttcttttggagctgctgacagtgtcatttcctttacacactgagaacatcaacacgtctaataaatctaatatacacaagtgacaaatgccttggtgtattcgatattagcccctttccatgtacttatgaccattacctaataaaatatattatacactgcgcctaactgcactaactgaggttacctactgcaggcgccatctctacactcgaagtcaccccttcctgggtctcttcccccacaccttcctgtgtctgcggagcctccgagccctgctccctgtccccttgagccccgcgctctcgctcctccctcatctgatgctccagaatatttttccttctcacggcctcaattgcctctctctgctcttcagcggtgcgtgccactagccgtcgcttgggcgtagtggacgaggtcggatttttgaccagacagttgcgcgatcgcagcgaatcctgggccttggcctgtgtcggcgagttaggctctgtgtcgtctgagccaggtaccggaggcggtatctctaacagggtagtggccacaccagtgtatgcaagctgctgtaactccagagtgtactcgtcgacaagatgggcttggacacgtgccatcgaagcacgggtctcaggtttggtgacaccaactcgcacgatatgcaaaaagtcgagacacgctgagtgcatgagattgttgcggtttccaagctgcaccagaagcgtcaaaatgggtccaaacaccttattttcaatcaagtgcgatagaaccaactcgtcgccgcccaccagcgcgcccttgagactccggatcgccgccagctgcatctgcttgttggaaaccaacaccaagcgcgacatggcgacccagattttgttatggatgaagaaatcccgtgcgatgaagccgtgcgagattgaacaaaagctcagcaggtcacacaggtgctcgtaaagcgtgaaatccgagcccgactcctcaaccagtggcccaaacagtctcagcatcgggccattgtaaagctgtcgaatatacgtttccgcacgctcgccggtttcggggtcaaacagcgccttcaacgtctccacagcctgcgttcgaagccccatgtcgcgctccgctatcagcaaatcaatcagaatattgtgtagtgccggctgatccactgcctcttcaacgatgttagtcacgtccatcatggacacgtcgggggtggtatctcctggtcctccagcggcggcagccatctctgcagtttgcccgattcctcggaccagattggcatcatggtccactagggtcaccaccagctccgtcccgagacttcggatcagaatactgtcgtctttgagcgcaaacgccaccagacgaaacagtccgtgtttgataaactgtccaaaaagcacagatctctgctgagtttgcaggtttttggccgttaaacagcatgtgtgaatgaaccgcactgcctctcgtcgtttttcgtccgatacaagaaactttggcgtcaaataagacagagtaggctgcggaagcgtcgaaaactcctgcggtagagtgggagtgattggtgagctgttttcaagatctccttctacctccacctccgaaacctccaccttgagcttctttgggctcgtttctgcctcgtggtttacgtcgacatcctcctcatctcttttgttcttgcggttcggggtatctggttctgtggcaggttcttggaggtcaacgcccgtatgtgggttgaggtcttcactgcaaaagttgatctcctccgtgtccggtgcattggctgcgttgcgggcgtccagagtgaagtctctatcttcgtcctcatgctcaaacagcccaaacaacgcctccaggtagttttcatcgccggaaatccagccaatgatttccgtttgtgagaagtaaatcatgttggtgagaatcgtaaaggtttggtcgtccagcagccgtgccaacaccacatctttgagaaattggatgcggaacgtctggcgaatcttgtcgcaaatcgcagcgttggaaatgggaatcacctgcttgaaccgcgactcgttctgtagatactgccggtggttggcctttagtcgcgggtactcggggtcatactccaggcagccaaccgtgaacatgatgtggtcgtcggaaaggagctgttcaaggatctgagagtcgttgagctggatgagccgtttcactgcgcagcacaaatggtgcaattgctgcaacagatgctggtcctcggcctgctgtagcagcggatgtaacaggccaatgtagtcgtggtcgatcacaaagccgatcatttggtcgcgggtcgattgagaggcacaaacaacagcagccgtcaagcactcctcaacagtaagcaggttttgcagatccgggggtggcggcatggttagaggcacgctgatgggttcatggacctctcctccatcggcggtgttgatgaccgccacaagactgatgtctggagcatacttcttctgaatcatgctgagcaagaaatcgcagatgatcttacagcccttggcctcctggaacgacagcgccagatcgttgcggccactctcgctccacacaatcaacgtatcctgctgcttctggtactgaatggatcccgtcacatgggtgtctagaatgaacccgaaacagtcctcgttttgtaccaccagatacggctgcttggacggacctcgagtctcgcccgtgcagtagccggtgcccttgtcgacccattggccggaatccagctcatacaccttgacacggtgcggtcgggtgggcgtctccatttagtagtagaacagacgtgcgtggcagatggcggggtggggtcacgtgatgaaatagtttgtcggttcgtcgtcgtcaatgtgagcaaatctcacgtcgtgtatcttgtccagctcacgtcttcttctcccgttattactaacactatggaaccgtctcgtgtatactgggatatatttagaaggcgagggttagggttttggaagtttgttttatgtcaggaacgaacatcgaatataagtgatgtaatgaagggaaaaatgatgatacgtcgagtgacgtggggcaatgtgggtccgagttgcattttctacttgtcgattgtgttttttttgccttgtattgaccgacaatcgtcacagtccccgacgttgctaggacaaccgggggatgtttgattatgtaatcatgaagaaggagtagcgtcagggagccgacaagtggcacagttaattttggtcagtgtttgggttatatttagcttgttagtggtccattgcggttgctatagaggcaatttcgggtctctgtgtggtcgtagtcgtatgtaaatactgcaagacatcggtatatgctgtattactgaaatagttatgtaacagtcgcgtagagtcgatatatgagctgtaagagctacaattgggggtttaattgctctccgatggtgtcagagattgtgatatttctctcaaacatgttatcatgaggtttgggtccgcaatgtcgaatattggggtgtatcgcgtgatacagtgcattttgagattaaatgtcttcatttgaaggggaaaacagtcgaaataggacgaaattttctggtaatcaaacaaacggtagaaaaatacacgtttggcaaaaatttcttttattttcccgtttttatccgactttttcggatttctcaaattcgacgacaaacatagattgccactttgaaacagactaacatgcccccacacaacctaatagggaaagtcgaggaagtgtacataccggttcgtggccgttgagtcaaggtaacgagtatagggcatgtactgtttctacttgtatattattgctttcagtgtatcgtattgtagcgggagtggtccggacttgttgatttgtctgggttacgttactctacatatatggatgtcttgtaagtactgtacgtaaaagccaactaaactcaacaaaccaccaggacaagtatgagtactgtgctcgtcctttttcaactccaaggagggagaaaaaaaaaggcagacattatatactcaattgtcaaagattcgaatatggattacacattaacggtcttggtttccgatataccgaccttttttttttccagtgcatatttcactcaactatttctgtcgtaaaatagttcagagcataaagtgcacagtcttgttttccagtacatactctgaactaaatcccactcctacgcgataacacgtgacaaagacctgaaatgtcatattccatccacaacacccacccacgtgacccaatccctgatctcgtgtttcacagccacacaacaacctgcattcccgtcttccagaaccatgtagcgtcatctcagcccgtatctattaatagctcggctatgctctgtaacactgcctgtatcatgtgtgttagaggggctgaacaactcgtgaaaaatgcactggaaaaccgcaaaaattgggcaagaaaccggaaacaataatatcaagcccgtcttggccatccaatcaaaatctcctgtccggaaccaccttcaaacagcctcaattccaacttcagcgtgcccaccaaaagtgggggagcaatgtccagagagcgaacctcgggagaagcgtagaaacggtggaaatgctccaaagaagcggggaaaaacactttgctactgtcaaaatctcctgctcactccctgtaccagtcccatcgtcgaatcatgtgactccagcggttttcccctgcctccaaacttcttcccctccaaaccttcctcggccttcttcgcatcaactcacggcgataaggtctagaacttccttcagagtggcttggggggtgtcacagctgacatcattgtggctgagtacagtaagtaagtcaggagtggtggtatattatctgatcacgtgacatactctctctggaggtctcaacacgaggttcccacgtggttctgggttctccaccgtacagttctcgtagctcgccgtctatttttaggtcgaaagcaaaatagcaaaacgctgttagttgtaacatccccccatttggtctcacgtgaccggaaaggcgccattctctgttgatccacgacatgtgtggtcgccgccttgtgtgcttcttgtacggcatcatatcgtagcagtgcggagctgagcacatcgatagagttccttgtgtgcgcaatccagcggtcgggctttagtttttcgtgtgtaacttttccgtttcccacccgagcgtcttggtgaaaatccaattggggtcttttggactcgagcaagtgtttccgattgtcccggtgacgatctgagctctggaagagtcactaatcgtcttcttgaacctgcatatcgtcgatgcacatgacccattgttgttagatgcacggcctccttgtgtgatccttgtatgtacgtatcgtacgtagagttgggcactttcagtctttttttgaataacggaggtgggtctgtgtggcccaaatagcggtctatggggcgaatggggcggttattttgcgacgtcggtgatttagaccgagtctccagactgtccggaatccagggcatttttttccagctctttcggccttctttctgtctctctatagcctttggactgaatctataaccacctaacgcagagttacgtcacataacaggcttccggtttatataaagacgtgtccaatcccccaggttgcccctcgcacaaccaatccacacataaaatgtccagcaacgactactacaacaacaacaacaactccgatcggggttttaacgacaacaactacaaccagggcggctacaaccagcagggaggtggctacggcaacgagctgccccctaaccacgacggtgagcgaggtctcggtacctccattctgggagccgctgccggaggctttgccggccacgagattggcaagaacggcaaccacagcaagctcgagaccattggtggagccatcattggagccatcggagccaactgggccaaggacaagtacgaggaccgaaaggacgagaagcgatgggagcagcagcagcagggctacggcggccctccccagggaggccaccaccaccaccacaacggcggcggtttcttctctcgagaggccggcaacgatgacaacaacaacaactttggtggcaacgaccgacgagacaactacggcggcaacaacgacaactttggaggcaaccagggtggcttcggcggtaaccagggcggctacggcggtaaccagggcggttacggcggcaaccagggaggcaactacggcggcaaccagggcggttacggcggcggtaacgacaaccgatggtagactcccatctccaacaagtacagtattatatagggtttaacgatgatttgatttgattagaaaaccaccgagtgcttcaatacaagctctagatctcctgcggggaggtcagtagggtttagtcttgttggaaggtggtattatgagaccgcaacaactagagcaagattgtcttcagtcagagctcggcgtaagtctgttggatcgggttcctctttggcactgttttcataccccacaagttggttgatgaatcaccttccagtgtgcgagacagacttgttctggatatcgtaggttcagcacacttcgtattacagatataacccaggactcagagttactttggatttggaggttcatatactgcggttgtattggttgttgacgtgcgataggagaggtggatgtacaagtacgatgactcagcatacgagtattgtcgcagtaacggcatgttgttatctgacagaggtattgtatatacaattgctacagagctatacgttctccagtctctcttcagatcagaattgccacagtttcagagcttgaattcaacccattccattggagggtgtaaaacaaagcgctatttccggtatgtagctaatttgacgacaggaacgccttctgcagacgttttcccggtatcgtagctagctaaacgaccgaatctcgtgagtcgcgaatctcagaatgaattgtgcccttcaatatacttgtttgctatttttttcccgactgtcggttccttacttttcacactaaaagtcactgcttaccaatagctcaaaaatgtccaccctgtcagaaaccaaacttagtacttctgctgatccgagaaatcgagagtgggtcttacagaccaataggtacgcgattacagtaaactttcagggacattttgattcatgtttgtacagtatgttcttgtacgggatgggacccaagtctacaatgcactcacacgctcggttctgcccctaaataggtctaaatctgattttttgagctcgcaaactggatgggcaggacaggaggtgataatagcaagtaaagaaactcatgagaactgacacggaactgcgcatcatgcacaggagccaagaccgccaagacccgccaagagatgcgccgttgggaactgtcggtaaaactttatgcagatcaggaaatagtaaacaggagatgtaggcaagtgcagttacgactggtgatgacacagatgttagggcacgcagcgaaactctagacaatgaaccagagtagatgggtgtatgttatgttttatgagtaattagtgcttgtacggaagagtgtgcagtaagttacaggttacctacgcacacatgttctatctcagacgttctctcttggcttcagagtgaggtgtttgccatttcgtggatggtagaccggtctgaaagctctggcagcattcatggagctggggttgagattgacattaggtatatccccgaaaagattggcgtagacgaccgcttgtttgcaagcttcgtctcgtctatgtagtggtatttttgtcgagcgtcggtgatgtcgtcgtcttgagatgacgacgaatcatcacggtaatatctgtaccattcgtcctggcggtctcggtacactcgttctttcgagtcatcagcatcgcttccaaattctcgctggcagagaacatcaatagagtcgtcttcttcgtcgcatttttcgttgcttcttcttcttctgctcggcctcaatcttctcctaaagctccctcttcttcatctcgagccactcctcttttatatctcccgcagtccgttcccaagggtacttcaggtccagaagtcaatacacattcttgaacttatttccgtcctcctccatccctccaacagccacagaccggttcataccttctctagtagcgtgctggattcggaaacctctggatacgtagcacagcgtctgcttgtgggctagttcttcgatcttggaggtgataaccagagctccggccgttctagtaagtagatgaacagtgctaccgacagccttttcctcgttttctgaatcaggtgcgagcagaaacaacggctcgtggtttgggccactagatactttccgtcgctgtatctaagagacgtctctgtgtgaagcagaaagtctgcccttcccttgcaagattcaaaccgcacgtgaatcagctttttgttctcacccaagtttctaacagacccgcgatcgttgcagaccctggttcctggggaagacgtggcagtacaaccctcgtcagcttccttctctcagccagtggttgtttcgacaccattagaatcagcttcatgtgtggtctccatgtctgaggtctctttgagcggttcaaaaagtgtcttcacgccctcgtcactcttgtcaatcttgtcaatctggagcacctcgttgcagctcagagaagcagccaccttgtgatctttgagcaggtaaatatggatgtttttgtcatccagagcctttttggtccgcgaaacaagcagcctgatactctctcttcatgtggatgtgtccgaatcacgtaaatcaaaccatggaacgcgtgccaacaccatgtcgcgtaacaacgtctcatccaagctgttgaaaagagcacgactctcggaacagacctgtcgtagccaaatgtacaattcaagatcgcatttctgataaattccaagcagaatatccggttgagcaggggtagtggtgcaagtagaaggggttgagacagcatatagaactatggcaggatagttacgcgaccagaagtgtagtatttggtattatttttcaaagccctcacttcaatagatgtagattatgttgatccacgtgatcgatggacggagaaagtgaaggctgttggctccctttctggctgacatagtcacttgctggttgacaatagttacttgctcgatctcggtggatcttgtgatgtggacaagttatgagtctggttctactattacctcaagtgaggccagacgataagagaaccaggatcagttggtcacagatgataggccttacagactgtactcctgtactcactctggtatgtacatactgtgctacggtacaagcacagtgattcgacctgcacagggtgtgtcacctctttgctcactggatgttcatcgaatgttcaccaaatgttcaccgtgttcatcgaatgttcaacgaatgttcatcgaatgttccatcaatggagtcttttgataccagtacggtgaatctcttcaacattggttcagggcgtattgcagcagtcgtttaagcaacaagaacgtccgggttccgaaggaggaccttcctcttctagtattcggctttttgagaatgtgtgatgctatcaacatctccgtaacggatgatctcaaagggatctctcgtagagagctacatgtccatccgaatatcacctcattttcgagtcaagctgaaacacacatggggtcaagatcatcaccaccacggatacacaccataataatagtaataataataatacattaacttattcttacataaacttgttcatgaggctggcaaacccactgttcttcttctttttcttgagcccagctccagcacgcttagtcttggcggcaggctgctcgtcagagtcatcagagtcatcagaatcgtccgaatcatcagaatcgtcagaagagtcgtcggagtcgtcggagtcgtcggagtcatcatcggagtcggactcctcctccttttcggtcttcttctgggaggcttgagagaatcggggctggctggaaggaatggagtccttcacctcaggaacacccatcttggccaaagactggagagacttgagattggagaaaggagacttcttgggagcctcgccttcctttttgatagcagagccgttggcctcgggcttcactgtagtggaagacttggaagcagtagccttgggagcagtctttgctggctcagacatgacagccgtctttggttcagtcttgacagtgggcttggtctcagccttagaagcgggcttggccccagtcttagaagcaggcttagcctcagtcttagaagcaggcttagcctcagtcttagaagcaggcttcgcagcagtcttcggctcaggcttggtagtagccttcgcgttcttggcaggagtcttgacaatggttctcttcttggaggtgtcctcgctgtcagagtcactgtcatcagagtcatcatcatccgaatcggaatcagactcagactcagactcctccttcattgccttcttggcaggagtaggctgggaagacttgggagcagtctgcttcactttgggaggaggttgggtggaaggaggcatctgtgaactcttcttggctgccggcttcgccttgatctcgggtttgggcccgttgtcagagtcagagtcagagtcagagtcagagtcagagtcagagtcagagtcagagtcagagtcagagtcagaatcggaatcagaatcagagtcggagtcagaatcagaatcagaatcagagtcggaatcagagtcgacatccatcttgtcctcagcctgagagtcggaaacatgcgtgtcctgggaagaaataggcgcggctttagcagcaccaagggttcgtttcttgacctcagtctttgactcagcagctttctgcttcgcctcagcttcggcgtttttcttggcctttgcttcttcagccatcttctttgcctcacgtgcttctgctgctgctcgggccttggcttctttggcctctgctgcagcccggagcttggcttctttagcttctgcggctgctcgcgctctcgcctctttagcctctgcggctgctcggagcttagcctcccgagcggcttgctgctcggccttcttcgcttccctggcctcctttgcctcctgagcggccttggctttggcttctcgttgctcctgagctagtcgggctcgagcctctcgcgcttcttcagcctcaagttgcttggccttctctgcctcctcaatcttcttcttgtccgcctcagctttggcggaccccttagccgcttgagcagctttttccttgatctccacctccagctttttggcagcctctttggcagccttttccttggcctcagcgtccttgagtttagcctcctccttgcgcttggcttcctcagctgcccggacagcctcctccttcttcttcagctcgagcagtttagcctcttcctccttcttcttagcctcctccttcttcttagcctcctccttcttcttcagctcgagcagtttagcctcttcctccttcttcttagcctcctccttcttcttagcctcctccttcttcttagcctcctcctccttcttcttcttggcctcctcctccttcttcttagcctcctcctcctccttcttcttcttagcctcctcctcctccttcttcttggcctcctcctccttcttcttcttggcctcctcctccttcctcttcttggcctcctcctccttcctcttcttggcctcctcctccttcttcaacttcagctgacgtgccttctcgtcctcgatcatctccttgcgcgcctcggcaccctcctgctctcgaacctttgcctctcttgcacgcatcgcctctgcacggtcatgctcttccttggcagccatcacggccgcctcatgggcattagcagcagctgtggactcccgacggacacgacgcttggtatcccgggcatccttgctcacctgtctagccttaattcgagcaacctccttggcgacctcctcatcagcagccagcttctcagcagcaacttgctccgccgtcagacacttgtagctgttatcagcccgcacgctgaaagtctcacggtaggccatcaactgccccttctgcaccttgttgttggcaatgtcgagctgcttgttggcggcctcagccagtgcggaaaaagtgcaatgaaccagtcggtgtcgagctaactcaatatcgggagagttactctcctgggcatgcttccaccccaaccacgcgttcagagaagcctttgctttggcaggagaaatgtggtcgcccaactcagaaggaatatggtactgggggctcttaatgtgaagccgaagagcctgctgagtgagccggctctcctcgatggcagccttttgttgagcacgggcctgcatgagagctgtgggaaacttgccatcgtcactaaactcagccaagaaagaagtgtcgctctcaggctcgggcttgcgctcgacccttggctcaatcttggcacgcttggcaacaggctccttgtctttagactcctttgaggtgggctccttcttcacaggaggcaaggaaattgccttctgtgcgtggggagggctcttcatgggggaaccctggatagctgccttgggctgcggcgacagaacgggtgtctgaatggtatcgagagaagtgctgcctcgaacaggggtggggtttgacacatttcccttatcaacaacagtggatccgagcttggaagaaagacggatgggtgtagatgatccggcagcaacctggctgctctccaactgaggataatggttgttggaagcaggaggagaaggtccagtcgtcgaggacgaggcgaaatctggccggggaggggggatcagcgaggtagtagaactctccagaatggagttgtggccggttccggtgcctccctggctgtatcgggaacgaggacgtcgaacagtcactgtgtgggcgtagatagcctcctcttccatggtgtggtcgaacgactcgggatcacgcacgccaaacccgtcggagtagacggacgagtcccgcttgagtcgcttggtgatctctttgggcagtgtgtatcgtcttcgcttgcggccatctctgctcatggtgctatcatcgacctgtgcttcgatcttagacacctctcctgcctctcccacatcctcctctagaaatcggatgccaggagcctcgccctgaaacttgcggaactcctcaatgtctgtgggcagccgcagaatcgctctcaccacatctccggacttgaacacgtctccagacacaaagctgggcgacaggtcgaggccagtgtcgctctgcaggaagtcgatccggggctcaaagttgtcagggtagatggacttgaaccgctcggcaatctcgtggcacagctccagcaaggaagatcgcgggtccgtgaaatgcaagaactttttctccacccgcatgcctgcttcgtcgatagatcgcgtctgcatggaccggtccggagcccatgtagtaacggtctcggactccagacagggcgaaattgcgtacacttggagtcgcaacatgggtgagccttagtcagaagcgcgcgtgtgtggtaattgaaattgggcgttgtaaaatttaaaaaaccgcccacgcctgttcaatgtgcctttagggttagggcgcatgcaattttcttgcccatgcttgatggagtcgcccaaggtggtttgagttcgttaccaaccagatagacggcgtttgtggctcgcgtagatggggttagggcattggaaggggcgattgagctgagagttcttgtgttgagtgcgatttgaggtgttttcagcgactatttgtgcttgggtttttgggatgttgtagatgacaatgtgagaagctgaagtattgtactttggtgtacttgagtttggtcagagttgttacatagagtcaactaaagtttaattataacaaatcatgcttaacaaaagcaagaaggaaaaatgggagaaaaagaagggaaagaaaaagaagaaaaaagaaaaccaacatgatgcgtggaacctgggcagaatcggtgcaattcaatggtaatgtgtcaatgaagtgatgtacaagtatttctattgtacagtgcgaatacttgtactacagtatgtagattacttgtatcgtagttgtatcatagttgtataatagtggtggtattgcttatagtgctatactggtatgtactgtactgtacgccgatacatacttgcgctagtagctatatgcgatccaaatcagcttggtatggacacaactcatgacattccacctacttgtgttctgacaagaacgaatattgtacgagtacgagtatagtaagtacttgaatgctgtatatacttgtagtgatgtatatacttgtagtgatgtatatacttgtagtgatgtacatacagaattgtactgggatgtactttatgtactcgtacagtatgtactgtatgtactgtacttgaagtacaatattatactggtatatactgttctcgtacatacataccccgctgttatctctttatcattcataataaatcatatctacttaataaacaccgacataatctgagcaatggtgatgagcagctcatttcgtttggcgtacgcaacaagggcggcaataatgatccaaagcagcttgttgccgagaactcgctgaagaacagtagcgtcgggtcggccggttcgaggaatcagaaccggtgggaacagggttcggagcaccttcatcttgtactcggagtaaggagggtaccggtaatacatgaggtattcaaagaagggccaggtgggctgtcccataacggcctgcttgtgggtgaagacatcgaaggagaattttccatggtatgctccggttccggaagctccaactccactgagaggcagagaggccagtccgacctgctcaatgacctcgttgatgtttacagaaccagctcggattcgggtctgtagccagtccacctccttggggtcgtcagagaagatgtacatggccaggggggtgtcatggtttcttgtgacgtaatcaacctgctggccgagggttcggggcttgatgatggggatgatgggtccgaaaatctcgtcctgcatgagaatgtcgtcatctggaacgttggagacgattgtgggctggatgaacttttggtcttcgtcggcgttctcgagtccacccacctggatgtctcccttggtctgggcgatcatgttgtgaatacgcttccaatggggcttggaaatgatatgggacagatcggggtggtgggcgtctctcttggagccgtatcgttcttggagcacctccttgatacaagcgacgagctcggcctccttttcgggagcaaccagaatgtagtctggagcgacacagatctggccggcgttgacaaacttgccccacacgattcgccgagcggccgtcataacgctcttgcagttggaagtgatgaacacgggtgacttgccaccaagctcaagagctagaggagtcaggttcttgaccgcggcctgggcgatgattcgaccaacggctccgtttccggtgtacatgatcttgtcccaatgctgggtaagaagggcggtggtctcggggacacctccgtaaacaacctggatgataccggggtccagggcctccttgaagattcggccaagaacagcggaagtgtggggagacagctcggacatcttgagcacgatgggacagccggcagcaatggcggcaatcacaggtgagatgttgagcatgacggggtagttccagggagtgatgaccagcaccactcccagaggaacgggtcggattcgggggttggcaaactggaaggggcctccggggttctccaccttttcttccttgacccactttcgcaggttcttgatgacggtggagaactcgtctcgaacaaacagtacctcggtgagctcggtttcgaacctgggtcgatggagatccttggtgaccgcctcgtagatgttgtcgaggttgtcgtagaacttgaaccacagggttcgcagctgctcgagacggtagtcgacagagtcgagcttgccggtctcgaaagagtctcgaagacgttgcaagttgctgtcaaacgtatcgattggcgtaggaggagtgattgtttcccaggacattgtggcggaagttgtacacccaacatttccggtctctctcactgtcttatactagcgcctattcgatttcacgaggacgaggggtagaggctaatagccataggctccagcttaagggttagtggcgagacatgttttcttcaggtggagggggtctgtcgagaagctggacatttagtggccaacaattgctgtcttgacgctccattgagtcgctagacactctttatcgtctcttcaagtgcccagaaacatcaatgtcaaccatgcacatgtcctgatatctgccgccagataaaaaccttgagcacaccatgccttttttttgcaggtaatgtggggttgtggggtcgggtctcagacaggaactaggcccttggtggggcatatctagtagagaagagattgactattggttgtaggtcggctgctttctttggattcgtcgatttctccgcagatgactgttctatcggcctgttgtccctcgtgtgcatttccccgtactttgccccagtgcatggctagttattgatttgtcgtatttggctctcccaaaatcacttttttgattactctcagtccaaaagttgagccgacgactgggtatgaattagagtttcgagaatgtggggcggaggattcgaacacgcgaccctgagttgtagttggagattaagtgccgggttctagttggaggtttaacaaaatggtgaataatggtgaataatagtgaatagtagaaaaggtgatcgatccaatgccaactacgcgaataatccaataaatataatatagcacttcacttctggatgcaactttctacccctagtttttcaccccttgaccagatctctctccaaagtgcgaagacgtctgaactcaaccgcaaccttgtcaataggctgtccagagacaatgatgatccaaaaaatgatgttgcgcatgccaaagtaggtaaagtcgtcgagaactttcattcccagccgattccacgccttttgctcgtcgggtatgttcttcttgtggtcgggacagtcttcgggtccaagaggcacctgtctacccacaatggtcttcagtttctggagggaggttgcaccggcacgcaacgttgacattcgagtgatgtccttggcgagttcgttgggactggtattagtgagagcagctccccagccagtgggcttgttggcagctgtcaacttcttctgtgcttctagctgtcgtttgaggtcgtccaactcgcccagagcagcaacgaggcgctgttgcaactgtgcgttttccgattgaagttggtttttgacggcttcgaacccggctctttcgagttcaagttccttctggacgaggtccttgagtggctgcaggtactgttcccaggaggactcgatgaacatgttgcaaaggagtattgatgagggagggagaatcgcggctcctcctttggttatatatcgcggcatgtatgtaactacttcaatgtcgcgatgtggctgttggtttttcgtcttacggaggtggggaattcacgtgggatgtgagtgcggtacgattacgaaccggaacggaacttgttgtacatctacgagtgtgacttgtattgtacttcccttacactcgctctacggtttatggacgatgctctgtttctggattactcgtggttcagccacgataggaccgagccgttgatctggttgtgacgattgttcaccttgatggtagagccatcaagtgtgatatccacatcaacctgtattactcattcgaattgtggtcttctggtcgaacgtcactcagccaccaaccccagcatcgtcattatcggtagcggtcctcggtcctatcaactccaacggagcgtccagggcacgtagcatcactccgaacttgagatcgctttcacctgggatgcttcagttacggcacgtactctgcgataccagtacatgttcgtactcctactcacagcatggcgcacggttcatacttcctcctcgataacgcgtctattaatagcaccagctgtgctgcacttcccgttgtgtacgctcatcgcgcatcaccctcgcgcatcacgcttgcgcatcatcaaaggaaacacggaagcagagaaaatcacgcttcgtcaggcggatgaggaatcccatatcgtcggttgaaccaaggataggtgatgtcacccgacatgacagtgcatccgaaagactggccctaaaagaactacagtccccacattctcacgtctattcttgtgcacaataaacgggaagtgcatactgtcatgtgaagactaacgggagtgcagggtcagagtttggcgagctgaagatgaaaatagaagatgtgaaaaagaagaggtgagaataggttgacctgttctgtacaagtattggccgcttgaaaatgtccacagaacaggtccacttgtacatatggccatgagtattctcactaacaccagtccccacccctgccttggtacaccaacgctcctacaagtacagtagagagccacccgcaaacacggcccactcgaacgcagtctgacaaacatatactaggttataactccgaactccgacctgaatcttcgtgtcggtaagacaagctgagttcaatgtccgacaatagcttgctgttgttaaaaccgacgtcataccacatttattgatacaagtttctgtacatttttgtatcaaggtgttgtgagtatttggtgcattacgtcattggtacaacccccacactgcccttttcgcgacacgtatgcgccacgtaaaacaggacgtggacgcccgcactaacacatattgcacgagtggtgtacgtgtaccaactgcaagtcgcaccaatgtccatgtcgtgtcgtgtgctctagtgtctatgtattgttcgtttccgtggactgttcgttttcgtttgttatgacgacgcgccggcttagagtttccgagcgaaaaacaaagccctggaacaagccctagaacaagcccgagaacaagtccgaaaacaagcccaaaagctcattccacgactacaagacaacgggcccaaaacacaaggggttcatagacaaaccacaaggcaacaataggtgcggggtgggctatggaacatcgatgcataactgacctccaatgtgacatatccgcctcacctcatctcatccctcatccctcccatcatgtacacgcacacacgtatattatgcgggatcggaatgtacaagaccaaaccaaaccaaaaggcccaaccattgtccaagtcgtaagatacaacgtccaagatccaagcgtgatactcactcaagcgttagtatcgtgcgttttacgggtacagtatgtacttgtacaatgcccaagcgtcagatgtgagtaatgttgggatggaggatagtatctggtagcatgagaagcgtacgagtaatcaagagtattacgagcacactacttgtactactcgctcgcgctcgcactcgcactcgcaccgagaacccttgtaaatcgcgcactcaggacttttatttacaacgcgatcaaacacattccgaacgggttctttgccgtcttttgtgcttatttattttcgagacatggacatcgcagacggtaaacaatggtaaacaacggcaaccatcggggctgcatttgccatcattcctcgatcaactgatctcctataagatgggcgtggacgccccggagagtccagcgatacgttcccgccaaaagtagggggacgtacgatgatattatggtctttcggacccgcggattcattggttgttgtccaccaagtataaacatccaaaatatccaaacttgtctctttctcgtcaacaagtcccaggtttcaggtccagagcctatctggtaatattgacatgtttttattgtcttggaggctactgcggttttagctgtgtggagcccaaacttgtgctgagaaaagtcgatcaaccgatcgacagatcgacagatcgacagatcgtcatgttactgccttaagcaggggaccacactcaattcccacagcaagcagtgggcgagggcgtccgatacgacgctgcaatacgtacgagtgcaagtgcaagtgcaagtgcaacaagtgcaacaagtgcaagaccaagtgcaaaaaaaagtacaagaatgtactgcacccgtactaattgtacttgtggaatcagccaatgactctctcattcacctaaaatggaaggtctactccccagtgggcggttacttggcattgacacggctggtttcattttgtttggccaaggatacagcatgccacggtgatattcaaaagtcgacgccaagagcccacgcagaatgcactgttttcaggagaaaggagtcccataataggagtcgacgataatagggagttgacaacatattaaagatatgagttcttcgtagggctttcggcagatactccgttgggatagttcatgtctggtagatccaatgacagagatggatgaagatggggtaagaagtgtgtcaagtacaatgcccgtacgagtaccgtacaagtcctgtatcgtaccatgttgatacttgtacgaatatcccaaaggtggtcgccacaaatatgtcaacgtcatctgaccaagtcacccgtctcctctcctcttctccgctcaggggatattattaccatgcactatgcagtcaggacagaatctgtgacagagtcttgtggccaaagaacagaaaatatttcgccggtgtcctcataatacccaataataacccgatgaaacaaaacaccaatttccccgttcttttggtgcattttctccgcggccctgatggcagttccagatctccgaagatcaagaaaagaaacgactggagtgcatttgaatgaggtgtacaggacaacagactgcacggtccaatattggtacaagcaccattatgaaatctcacaatgtccaattatcccgacactcgccagttgtcccggcactcgctcgttatccccgacactagcccatattcaaccacaccacatttgaccaaacctgtgactactggttgaacgttccagaactgtaagtagagcggccaaagagtggctaaaacaacggtaaagcataccaagctcttgtgcatatcaaccattctttagagaccaaactcaccagaatacaagtggcaattccagtcgtgtgctcttttcccgagtccgatacaaggtactccaactcctactagaacacgtcccctactcgctcttcactatagcgctggcctggctggactcgtccaaacgcatacccctttgaatgcaatgcatctggtcaaccccttacatggctcatacacgtcgtgcctctgccttctgtctgccagtacatgtactggacaattgcactgctgtttcatccaccaactttttcacccccgctgcatagtgcgcgttggaaaaatagagtttgtttctttgtcacgcccagcctggttctaaccacgatgagccagtacggagagacagccagcctcacgacaaacagccccgcactcggcttttcgccccaaaggtagcaaaaagaggccggattcaccacggcggagcctgtctcaccccccccaccgccccccccgagcaatattacccacccctacacctatgataggatgctataaatgctagactcgaaaatacgcgtggctgagaagggaacctaaatcagcttgtgtgcgcagctttgcaccaactttaattagccttttcctacctggcacgtcgcgcgcatctttgttgtcgacactagtccgaattgagccacctctattatccctttgagtttagagggatatctcgattatcgatgtctggccacctgggcttacaaaggggtgcccaatagagagcggatgatgtttcccggcgctatgttatcaaatgactcaaaatgcgccccaaaacgccaaccgacggactccacttgacagtgttacagctccaatgtctagcactcctaaaccacattccaaagcatccaacccaaaagctagtatctccttgatgaaccttttatagaaaccttaatctgtgtttcgctacacacttccccttcatctcctatttttatcgtctctgcttcctcatcatcatctcagattttcgctcttttccacggtcgttccgttttctcacctcagtcattccttagtgagtatcaaccggctggggccgtagcgccaggacttaccaacacagacagacagagaatacagcaacacggacagagaaacaacagagagaattcacgcgataccaaaccaaacacacgacaagttggacacagacacagagacacgaacgtatcgacatcgacacagatacagacagacacgaatgcatcgacagaagggacacattctgttatataccatccatattcgacgacaagcggtggtggtgtgtggtgtggtggtgaggtgaatggtgtagcacacaatggctcacgctacgagtgtagcttgtcacttcccactcctgggagttcgagtctgacatgtcttgtacagttcattctgttacatgtcctgtcacacacattccgagccccctgcttaataatcacgcatcaccacaaccactaccactaccacttacacaacacaccaacaccaagacacaccagcccacaccaatagccacccacaacccatgtaaaacgtcagctgaacaaacaacccctatacccctcctccatcgacccctatcacatatgataccctggaccctgaccccttgttccaaacactatacatatgcacaacgtggggctgttacagatacgacacccacaccacgacccaccacgacccactctgtgacacacgcccatactgcgccaagtgaaaagattttcacgctctctgtccgtttcaagatatattcctggctctgcatggctcccttttttctctttttcccgcagctcaccgtccacttatgacctatgcatgttacatgtgcatagtccctgtggcagggtgcatagttggtggtctagaccaaccatttccgagcccttgggctattgcctcgagctattactctgtggcttgatgctacattgctctcgagtatcttttctgaggcgtttgcggccttgcaaccactatcacagttacactttgttgtcccacaccaaccttgcactgcttacggttcctgaactctccccgaacgagatatcccttttctagattgggatcccgggatctcaaacccaaagccttgctgcacagtggagccaactctgtggatgggagatgcgagaaagatgcgaggaaatgatgcgagaaaaaatccggccatccaaaacgtcatactaacccagtgaaattctcatctgccgtaatctcggcatttctctcctttgcctatgcttccggatgccagcagattgctggcaacacctactgtaacgaggtgtccgaagtcacctaccagaacattggtttcgctggttcctacaacgccatcaccggcatggactccagctcttgtacctgttcttccgccgtcaaggccttttctggccctctggcccctctgaacgaggagctctccatctccttccgaggccccgtgtctctgaagcagtttgctgtctactaccccaacagcggtaacgccaagcgtgatgctgtcgaggaggaggacaaggactgcggcgagaccgccaagcgtgagttccacgcccaccacgctcataagcgaggtgttgtcaccgagattgtgcaggtcacccaggttgtctacgctgaccagaacggtttcgccatccagccctccgacgctctcacctatgccacccagaccggtgcccccaccgctggcccctcttatgttggcccccctcagggatgggagtctctgtcttctcagacccagtctatcccctcttccaccattgccgttccctccaacgtgccttctcaggctcccgttggcaactctgactggaagcgatctgctttctacagctcttcttctggccagtctgacggtctcactttcctgaaccaccagggaggaaccgctggttccggtacttgggactcttgtttcggaaactccctgtccttctgcggcactgacggagtttccggtgccggatctcctcaggttcttggcgatgtcaccatcccctccaacaaggagttcctgatcatgtccgacaagcagtgcggcggcaacgactgtggctacgtccgagagggctctcctgcctaccatggctttggtggaaccaacaaaatcttccttttcgagttctccatgcccaaggataactcccagggcttcaacgctgatatgcccgccatctggatgctcaacgcccagattccccgaactctgcagtacggccaggcctcttgttcgtgctggaccaccggatgtggcgagctcgatctctttgaggttctcaactccggtaacgacagactcaccaaccacctgcacacctggcagggaaccggtacccagtatggcggtggaggatctgctgattacttcactcgacccacttccggtaccctcaaggctgctgtcatcttctccggcgacaactctgagatcaagattgtccagcttgacgactcgaccgactttgcttccggtctcaacgccgatcaggtccagcagtggattggaaagcagcaggctgctgcctttgtcaagatcaactcctaagtgtctccaacgacgtattagacagatcgaggtagggctttttttatatataaccaataaataactttttgatgtatagagctgggggtgtgtaggactggtctgcttctcgtcatgtacgtatgcagccgccgatgcgatgagctgtggacatatcagtttcaacggtcgtacagtggaaatcagggccgcgtgcatggaacatggaaccggagcagtttgtagagaattggtggtgggctacattgtgcgtgcggctgtgttccggtaattactgccatggtatgtatgatatgatatgtacgagtatgtacgagtaattacttgacaggagaaccaagaggcaagatggaggacaaaaaaaagaagacaggcgttccaaggacgtacaacaaagttctggcaccgttgcaacggtttgaatgttgcttgggtccagaatgtctgcagtagcaccaaaacggttttggagaacatagagcattttgatgagacgctagattggcattttcaagtccctttttttttttttaagaaaagccgaattatccaaaaaaacaaagaaaaacagaaaaaaaaagaaaaaaaaaggggtgggggcacgagttagtacatcgttgaaatattaatttcgacatgagattttcattcgttattcgtcgcatccagatacatcgaccgaaaaatatatatatgtattatgagggctgaaggtagggattaatgcacttttttatcattttttattttttgtaggtacaaacacggatgtacgtaaatacaagtaatgtacgtagattcaagttctgacaaataaaaatatggggtgtctagcagatctactctggtgagagtacgagaactcgcacggtgaagatagaagcagagactgaagcagaaatattgccaccgagaccgtcatataattccgcaaccaccacgtgtctcttgcttatctctggttacctctggtatctcattgctaccgtatttgcagaggttcaagccatgtctcatctgcttactataagtagggttactggaggttgctacggtgcgattccaagcagtagaccaatagagcgggggataagagccactaggctattgtggcagtttgtattaccctacacacgtttccacggttgccgatcacgtgatccacacacacttcaaatgtgcagctggccaatcagcggcgtcttcttgctgcttacggctccttctgccagccctaatttatttccccttttggaaccgaccaaactggaaggggtgcggaaataaggttgggtaatttttcaaagggtgcaaaaatttggcacaccacgaaccacagaactacggaactccaacatcataatgccgcccaagaacaaaaacgaagtcaaggacggagacaagaacacgcgtattgctattgtcaacgtggacaagtgcaagcccaagaagtgtcgacaggagtgcaaaaagtcgtgtcctgtggtgcgaaccggcaagctgtgtatcgaggtgacgcccgactccaagattgccttcatttccgagacgctgtgtatcggatgtggtatttgccccaaaaagtgcccctttggcgcgctgcagattatcaacctgcccacaaacctggactctgaggtcacccatcgatactcggccaactccttcaagctgcatcgactccccactccccgaccaggccaggttcttggactggtgggaaccaacggtatcggcaagagtaccgcgctcaagattcttgcaggcaagcaaaagcccaacctgggccggtacgaggaccctcccacgtggcaggagattctgacacatttccgaggctccgagctgcaaaactactttactcgggtgctggaagacaacctcaaggccatcatcaagccccagtacgtcgacaacctgccccgagccatcaagggacccctgcagaaggttggcgagctgctcaaggccaagctggagcgaaaggacgactttgagaacattgtcaacaccctggagctcaagggtgtgtggaagcgagaggtgtctctgctgtccggaggagagctgcagcgattcgccatcggtatgtcctgtgtccagctggcccaggtctacatgtttgacgagccttcctcatacctggatgtcaagcagcgtctgcatgctgctgccatgattcggtcgctcatcgactccaccggttatattattgttgtcgagcacgatctgtcagtgctggattatctgtccgatttcgtctgcattctctacggtgtcccctccgtctacggagtggtgactctgccctcgtctgtgcgagaaggtatcaacattttcctggacggtcacatccccaccgaaaacctgcggttccgaaccgagtctctgcagttccgactcgccgatgccactgagatcatcccccttgaccagtcgcgatctttcaagtaccccaccatgagccgaactcagggcgacttcaagcttaacgtcgagtctggagagttcactgactcggaaatcattgtcatgatgggcgagaacggtaccggaaagaccacactttgtcgacttctggccggcgccgtggctcctgatgagggacagaaggcccccaagctcaacgtgtccatgaagccccagaagattgcccccaagttcactggtaccgtgcgacagctcttcctcaagaagatccgatcctccatgcatcacccccagttccagaccgatgtctacaagcctctgcgaattgacgacattatcgaccaggaggtccagaacctgtctggtggtgagttgcagcgagtcgccattgtgctcgctctgggtcagcccgcagatatctaccttatcgatgagccttccgcttacctcgattccgagcagcgaatcatctgtgccaaggtcattcgacggttcattctgcattccaagaagaccgcctttatcgttgagcacgatttcatcatggccacctacctggccgaccgagtcattgtctttgacggacagccctccgtcgaggcctttgcccgacgacccgagtctctgcttaccggatgcaaccggttcctcaagtctctcaacgtcaccttccgacgagaccccacctcgttccgaccccgaattaacaagaaggactcgcagatggacaaggagcagaaggctcacggcaactactttttcctcgacactgcggaggcttaagcgaaagatggaaatcgaatggaggattcaacaacgaaaattggcaacgagtagcaaaataactaggatagttacaggcattctaatagatgtgcggaatgaaaatgattggataagtgagagagagagagaattagtagggttgaaacaattacataaaaccccacagaggctgtatttgtataggctgcggttatttttcggctgcaatttttttcccattttttatacgaattattcccatttcccatcctgcataaattcagattattcatttcgccttactaataatataaggtttggaatcatcctggaaccaaccaaccacaacacagatttatcaccaagttagactacgcacctcgaatacgaaaatgtctggtgagtacgaaaacgccaataggcgctcattgaggaatgatccggatgcgaaaatgcgcggaatcgccgttccgttgctccacaacgtcgccgacgtgattttaccgcgcgcgagacagaaactaacacagaacatcagcgacccgagctcgtgtcttttgacgacatcaactacaacgaccacaagaaggtccgagaggcccaggagagctacacacgagagcagttcatccgactggaggctctcaagaccgtgcgaaaggctctggagaagtgctacgaggagtctggccccaaccactttgaggactgcaagaacctggccgagcagtacctggacatgctccccacccaccgacttcagggataccttggttaccagcgaaacgatccttccaagtaagtagttatttatgcatgtttgatagatgtgaatggtactgtaccatttgctgagctgtagcggagtgaggaggacagtgcaaaaagagacccacaaaagagatgcacaaaaaaggacagtgaccgggttgtactcatactcgtactcatacttgcactcgtacaactagtccgatattatcgtgtagtgatggacttgtatttatcggattacataatgctgatctctgcgatgaccttagaacaatgtgacctcagactgattggctcatcatagtggtctcacatcaactcaaacacgtgcaagtgtgagaattacttgtatcgtatcacatgtatttgcttctcttcctcttcatcaactctatcatgaacttcacacaagacacccaactgctagaccaatggcaacacctcgtggggaagaaaatcgtgtctaagaacgacgtctcggagctctcatcttcggaattctacaaggaagaccttcctcagcccaaccgggttcttgggcctatgtcaccttgcaccatggacttccgtcccaacagacttaacgtcattgtcgacgataacggggtctgcgaaagggtagatgtttgttagaggggaggaattgaccccgaggaaccggtcccgttcattcgccacgaccaactactcatattgtgctacacagctttcagacgactgcgatagggtgcgatacaccacgagtacagtatgtacagtatgtacatgaacagcactcgtattagacgaagattcggaagttgggcagtatcacattgtgtatcttctgagacattctcgtttgttcaatgatgagacaggttgatctacagtgacttcagtttgagcttagagattgaagatatacggtatatactctttcagtacaagcttcactttatatggtaacactgcaactgactctgatgactccattgaactccaggaaagagcgccgaattctgaaatgagtgcgaatggctgcttaatgttttaatttgaagttcacattattcatgtcccggaatatctcccatccttagtccttttgacgtcccaactaatcccacccattcccaactaataccaactaaattactcaacgatatggcactaccattttccattttccgcgttccgtctgaagcccacaaacttccacagatattcatctagacgcttccttacaatgacatttggactcttactttaggagacccacgagcggctgactcaaagccgctctggtggaagaatggcaacagttgatgctgatggctaatatggaggcgggaatggaggctgctcgtccggcactgccgttccaccgacgaaggcacagtgtctaaagccgtcgaccagctgactacggcccataccaagctcatcaaacacatgtccgctcgacgaaagagctcaaacagaaggacatcaaacaatgaacatctgcgttgttcgtgcggtactttcggatttcgcccattgccggccggtttgagggtctgcggatgccgaatctgaacgactcaaaatgctttagatccacgcgaaaagatgatccagaacaccagagactcaagctcctggggccggtacaggaagatgcagccttgttgcagactcacattcagtagagatgctgggggctaagatgaagggaccaggaacgctgttctgatttaaaacaagagtacagcccaattgatccactactggacccgtctgtagtccagacacgcaatactttcgattgtccattgattttctcccccaaagatccagagttgtgtgtcaactagcgaagcgtcaactcctttcggttgtcagcttaccaatgatgtaccatggggcgtttgatgtacctatacacaccgtacagcagacccttgttgctgataaaaacgagaccgtagtccagcatagacatctgatcactgcgccactgcggttttctgcatataaaccgttctttcaggcaatggcagggtgtaatcttctccatagatcgacatgagtgcaaaatgtgattatcatgggtgttatgggcgcgaatacgtggtttctggtgaaagagtggagggtggggaggtatcggagacgagaattgtccattttggagttgagaaaccgccattaatgtctgtataacgacatttgttgccggtgaagcctcctctccctctggagtcaattgtcaacggcgtctaaaaaaaagactgacgtcactctctcctttttttccccctttttttcatttttttcatttttttcatttttttcacaattttttttctcatgccgatttatttctgaactcaaaactcctcggctggaagggaatataatggtcctagggactccgagaagaggtgaaacgagtaaaacgggctgaattgcgactgtatcggctcatagcaactcttcccagttgtccttcgccacatccacgctgccgtgggcgtgcgggacgtgcctcatccctccatacatggcaaacgcaggtcggatgctaccctcagagttcaagatgtctcttcagagatcggccagtattctattttgagcacagaatcatggaaatgtccatcaaagaccatagaatgacgtagactacaccaaacaacaatatataaagctcggatatttccctccgacactcacaatgcagttcaagactctttccatcctcgccgccgcttctaccgctcttgccgcccctcatcagtactccatccaggcctccattggcctcggcgccacggacctcaagtctctccagctctacggcaacaacattgtctacggcctgacccagggctactccgacttccgagccgaggacgaaagcgacattatcaagctgtttgctgagggctaccccggtctctctcttgacgtttcccagaacggtgagctcgccttcaagtccccttccgagcccaagtagggcttcacctttacgggtgacggtgacgtccaggatcttgagttcgacggctcccaggagttctactcttgcgccaacaagttcctcggccctctccactccccaggttgtctatgtcaagactggcggcaagtacgagatgattcatataattaaatgaatgtatatgcagaaagaaaaaagattcattacagcattttttttattctaatgattcattacagctatatacctacattgtagtaagccgggttattgacgttcaataaatcatacacttctgaatctttgcgatgtgcgctgcggggcgctgtcggttggtttgtcgacgcttcgcatacacgtgacttttttggtccaatatatatgcctaatggtttgttagaccctgtaacgattcagaagctagtcataaggtgttatgattagtcatgtgccttggcacgtgactggacgatgatgacgtcctccggacgtcatgagtgtgtcattatggatgaatacttggtatcgcgtggctaggtcacgtggatagtgacgtgctttacagagttagggttgagatgcctgtatatatagccaccactcacaagtatgtaagttaagttatgtttatacgacttccggagctcgtactattggtgtactgttctgtagagtaggacgagcggttcccgctcgtacctagggatatcttgaggattgacccatcaccgatccgttacagacccatcggttgcggccatatcctggtgaaaatacggcttcccgtccgatcagccatagtcaagcaccagagagcctagttagtattgtagtgggagaccatacgagaatcctgggtgctgcaatctttttgcgagtttttttggaagatgcggtgatttttttggaaaaattagataaaatttgaatttatcctgaagctatcctgcgataaatatagagagaggaagtccaagtatgctatctagggctactgtaccagtcttctactgatctctaacgtcaaacaacggtttccatggatggttcgagaggctggacccttcacctaggagactgtcagaggttcctgtccaaaatgcacttgccgggctactgcccatgatacgtggacaattgtaagatactccccaatgagccactacatcctcaagtctcagaagaaggatacgtcggacatcaagttgagccaaaccgaagcagtttgtgaagtatcgtttcggaccctgccagcttcaacgggcccatttttggcgaaaagacgtatcgttatcgttaaccccatcgtcattgatctccagcacccatgtctcatctgaaaaacgcacatcatcgattttcctgaaacccttgtgagactggtacataggaagacaccccgaactgaagacttccatcggtgcagtagaagtcatcatacccagctatgagaagcaccaaaggtctgtagttggtcgaagctggcaaccaggtcaattaccagatccaacatatctttccgggctacgtcaagagctggtttcaccaaagatgatgtccaagaagacggtcaagtataagcatcagtccaaggagcggttgaggagttgatataaggaggtgattatcctcacttataaatattgtctcgactcaaggcgtaagctcgtggttatggactagagacttgtcatctgacaggcgaagaacagctcattggaggtcggctaatttcttcgacgtgattttcactccacatccggtcccttgacactttttatcgataacccgatctttcttgacatcgggagaaggtctgctgcatctgttgtagtaggtgtcgttatgattcttcattgatagctcgttcgttaactcctgctcgacggacttgcacgaagggtattgtacccagcagattccaagctcctccccaaccatttagatgtgctccaacgccgagggaaaatcaacaaacacgccctcgtgagaaacgctttcaaaaggaacactgggcacaatacacaccttgggatgctcgtagaccaaacgtactgggtggtgatggattaaagtatcactcttggaggaaccgagaatgccagtgtcattggagccgttctcattcgtctctcttgattgtcgtctaaatcaaggccatctttcccatcgtctcaaaaaagatccatttcagaatcagacaagacgtcgacaaaaccctcgtcaaactcgttatcatcaaccagtccttgcatatgtaagtccttatcgtggcaggcaacaacagcatcaccagcctgtgtgtcgagtcgtcgtcaccatcgttaagggagtctttagtgtagtcttcatcttcgattctggcgggcaagatgcagcagggctgttcagatgttctaaagggaatgtatcgctctcggacgtagcaacgccagtcgagacccagagatctacctcttctttaccgctcttgccgatgcggcggccgtttggcaagatgtgagcatcggctttccccagagcaattgatttccaagggctagagatgacatgtttgaactcctcgtcacttctgcatgcctcatcatcttgctgggcaacacctgatcgtgcatcagcttggtctcgccatcattaacttggagttgtcacacacaacgtgaacctgacaggcttgtcttgaagctgatcgagatctaccgctgaatctccgctttccgtataggcatttccgcctaattctagcaaggcaggaccaatctcaaaccacagagcgggttcaatccagtgactgcgacgcacaagtttcaaacatcaaaactagactcatgttggtcgctatgttagtaatcactcaggtacttcaaagctactcctgctgacgagtcgagtgactcagggacttcatcactcgcccagtggctggtgatggtggtggagataagcaggagtcggacttgtaatcatacgacgcgtcgttttgacttttttttttccaacacgaaacgcgaaatacattaatttttgtggagaaaaaggagacatgaggaaggcttcgagttgtccgtgaagaaagaagaaatggtgagcgtattccgagacacgcgctgaatgaaccaatctccttgaagtacaaatcaatggaataccgagtcgtgtagtaactccaaaggcggtttgctattagtaagtacactgtatggatgtactatagaagtatctttccagacctcagttgcacctagtggcactccgcattacatgaggcactgctatatcacatcacttgatgtactggatctacacccgcttcatccacccttctctacctctaaacatacattgcactatattgcttttaccatcttctcctcctctaattacttcttcttgggatcctcagcctcgtcctcggtgtcggtgtcgatatccgaaagatcctcctcctcctcggagtcctcctcatcgtcgtccactacggcggccttcttggtgctctggccccgggcagaagccagagcgccagcaatggagtcctcctcaggctcggaaatgtcgtcctcgtcgtcgtcatcagcgggaatctccgggttcttgacctccacgttcagcttctctacagcatcgacgccaaagtaagccgtgttgagcacgttaaccttgtacgaaaacttgccggggaacatgggagtggggttcttgagctggatcttgaaggtgccgataacgccatcctccacgtccttgccaggcttgagattgctcaggttggatacgtcgagccgggtgatctcgccgggaccctcgacaatcttgttgtccttgtcagaggtgataaacacaacccacttgccctgatggagagcagggaagtagggtgcgtaggtgtgaggcagcagaggagcgttgctgttggtgattgtgggctccttgagcacctcgataggctcgtcgagatgcagatcatgcttgagcttggcggtatcaatgttgagaggtcgcttggttccaaatggccgcacccggattcgtagaacaagatgggcagcagactggggggtcaccacgtcttcaccaggcaccttgaagtaggcatccacaatatcaatcttgggcacagcgttggcggtgttcttgaccgatgtaatatcagatttgtcgacgcccagaatctccttgaattgggcatccttgaagcccaggatggagccggtaccgtagcccttggcattcttggtcacctgctcgtagtccacgtgagggagctgcagcatctctccaagaggaagatggtcgagagaaacggcctgaaccatggctcgctgaacctcaataattcgctgaaccacctccagaggcttgaactcgatggcaatgtcggcaaagccatccagcagcttgggggccaaagcagccacgcccagcatagcggcgggcttggaagaagcctttctgtggaggtagtcgtctagaagctcgtagacctgcttgctggtgagctcggggaagttgattcggtactcctcggcctcggacacggcctccaggattcgcttgtgagtgatgtagtctggctgctccttggccatgatggagaagaaccgggctgcggtcttgttgtggattccacgacgagtgtaggacttgactccggtccaccacttgccaatggtgtaggggaggatgactcccacgacaatggcgtagacaccaatgagcaagggagagccctggccctccacgagccacttgggcagagcaataccgtggtcggtctgctgggggccgtcaggatggccaaactccagaaagttgtttcgggtgacttcgtctgtcagcgccttgtaggcctttgtgatctggacccacgcgtcctccacctgctccatggtctggttagccaccagcttgatcttgtcgggatgcagcttgaccgacagctttttgtagtggctcttgatttgcttctctgtggccgagaaggacacgcccagaatctcgtacggatcaaacgtgtcggccttgaccttgacctcctgttgtgaaatgaacaccagcgctccaatcagagccgcccaccccgcaaccagagccacgttgcgcttggacagcagctttccgcgccgttgcttgctctggaacgagtcaatgtccgccgcatgggggggacggaatggagtcacgccctcgggaagagtcgcctgggtcttggggggacacagaaccggatagacggcactgagagtccaggggactagcaccagtgagcccaacgtgaccgcaaagtatggccacacgtccgactcttcatcataagagtacgaaggcatttttgagtctgtgttgtggaaagaaccaaaaatgtgtgatgtacagtctgtagatgacaactgtggttgggagtgtgacgtgtagttaaagtaaggtttggcaaagtagatacagtaggtggaggaggagtagaaatggcgaacagactggagtaattttatgggaataggcggtgttgttgtttttttggtcatgtgtattgtcacgtgacttgatttcacgtgactgtttgtttctgaggctccctccttcccccttctgtggtcaatcgcacactacttttcaagggtaagggttgcatcgtagatcaagaacagggtggaataaaaatataaaatataaaaaagtgtgaatttatatagttcagtttattactcactgtagctcagatggacatggagctggggacagaaggcgaaaacacgagttcctgagaatcaattgtgacatgaccgggtctgggaagtcgtgtgaccaaatgtatatcacattacggccgcacttgtagaccaggtgtcccacatctccacgccgttccgtcctcctcgtcctcctcttcttcatcctgcttgcaatggcggcgcgcgcgtatgtatgtatgtactgtactgtactgtactgtacttgtagatgggcaagtttttgctgtctgaagaaaagacgagagcaggacgaatttgcgagtcatgcagcggggatggaatacgacgaaacagtcctaacctgtgtttttgacgtaggaatcacatctcataaggtgtttttccagcgtgattgattgacttttccgaggaggtttgaatttggattagtacgagtatgtgagtgtgtatagggagagtgatggagacctggagagcgaacttttccagggttatatggtatcttattgtttgaaatggccaacttattctccttatgagttttttattgaaaccggatcaactttgacggagtttgtgcagtcttgatggtgggtgtatagtacagtgtgaaccctacaactgtatgtaggtttgtactgtatttacatttactatggttgacgtatggctatataatgaagtcttcgagttataccacccatttggtattctcttcaattaattcagagcaggacatttatcagctcgtcgagttatcagccatatttcaacttgcattcttttcttttttcacgctttttttctcgcttttttctcgcttttttctctctcgacttttttgtttttatttttatttatttttcttttatttttctttttctggttaaccctgacaatatatcaactacgagtttaaatctagtggagactgaaactgaaactgatcttttacttggggaaatgtttgtttttgggcgtgaaaattgatacccttgatattcaagcgtcaaatagctgaattattatccctcttttgactctagacacgtcccactgcttctacaaggacatttggcgcaggtctcgattctcatgcacaagcaaaaactacacttttttaaattggcgtgcattttcattttcgtttcaccagtaccaccacaaacaatgagttatcgaggacgcggacgaggccgaggcggctacaacaatagcggcggccgcgacaacaacaacaacagcaacaacagcaatctgacggacattgaggtccgagggtggacgaacgcgcctaaggacgatcttgtacggtttctccaggacaagggcgggttccggttgcagaacccgtacgtggatggcgacgtgatcaaggcccgagtcaaaaacacggacgcccgtgcgattggacaatggtccgggcgccggtttgcaggccaggctctgcaaatcacagtcaaagatggaccctcggctgctgcgcagtccacgatcgaaacgctcaaacggttccttgaaagcagatacagcgccgaggacaagctgctgaaccttgcaggcatgggccaggaccagtatctgattgagaatggccttttggccaccactgagcgaggatcaaagatgtttctggcgctgctcaagattgcaggcgacacctaccccgtggtggactcggtggatctgggccacaacagcatcagcgacattgccggcatcacgacgctgtctcagacgtatccggagcttaagaacctgtcgctagccaacaaccagattgcccgcatcaccgacctcgagtcgtggagacacaagttcaagtcgctgcgagaattggtccttgtgggcaaccccatcaccaaccaacccgactaccagcagcaggtggcgcagctgttccccaggctcattgttctggacagccatgtgattcgagacgagtcgcagattggaaaagtcaagtaccccatccctctacggcaaacgttttttgaaaatgacaacatccagcaaatggtcggcggctttctcgccaactacttccagctctacgacacagaccgacagcagctgttgcagctgtacgacccacaatcgactttctcggtcgccatctgctcaaacacaccccgaacaatggtcaagggtctcggtcagcctccctggggccaatacattccgctgtcacgaaacatgaccaaggtgaccacagcctcggctcgaaccaaccgactctatgtgggtcctgaacagattggaagagcctttactcgcctgcctaagacgaaacacgatctcggagacccctcaaagtttgccattgacgcatggactctcaatggtgtgcgagagccgcaagacacagccatttttgcgtctgtgcacggcgagtacgaggaaaacatgattggcaacaagagcgacacccggtcgttcgacagaacgtttgtgcttctccctggccccaacggaagtatgatcatcgcctccgatactctcatggtcagatcctacgccggaaaagacggatggaccagtgcagccatgactggagcaactggtggagctcctggggacgactttgccggtctcaaccccgatcaggctctcattgtcagacagctcatggaagccacccgtctaaatgcaaggtacgcgcgaatgtgtgctgagcaggccggatttgttccggaacagaccatggcattgttcaaacaggcccaggagggaggctcgttgcccccagatgcgtttatgtcttaaccggggcccaaccgtacaggagacaggaggcattcgtgtgtgcattatgagacagcaaacagagtaccgtatgtattaccgcatacactacgctctcacaagcatgtagttaatttgaaatgaatgagcatatcctgccaaacatgtaaaagtaatttattgatcaattgaaacaatctttggtgtgaacatgtgtgagtagttgtagataggcaagtgaagcgatcctagacacatttttatgtggtcacgtgacctaatttggattctggatcaaggattatctctacaagtactgtacttgtagtatgtttcatttggctccgttgtactcgattagttcaactttttgtatagaaagttgtaaatatatatacaccaaaatgatgcttgtgctgagagccacacaattgtgtatctatatttccattctgagcaattttctttcgtctacttgtagatgatttgtgaccctggtcttacagtgttcaagggtcacaatctacaatccgtatattagaataaatacacactttggtgtgttataaatattgtatgagagagtttcatgggaggagcaggtactcatactcgtactgtggatactctggataggtgcttacatctcctcgtatcatgtgcgtacagaaggggttccaatgcctggcaagttctgctcagcttctgctagccagcttctgttcaaccagccagcttccgctcactttttttgttcgctaacacccttccctaaccaactttctcaacagattcacctccaactcaatctctcttctaatctccgcattctccacctgcatggcatccacctgctgattcctctcgaaatatcctggttgcaaatctcgatgcaaattgatatttcgaaccgtcttttcccatgccagctgccgcaccacatccagacaagatcccaggccttttctgtactccgacacaagctgtaatgtctctgagttggtttttgtctgctgagccacctgggtcctcaaaaacgcgtttttcgacagctgtgagtcgagcaaggcgtccgagtcgccggtcgacggcaaatactcgtcgctgtcgctgtctttggtcgcttcaacctcctccatgacatctgaaagcgtgtacttgtcggcctgtcgaatcaacttctccaccacctcttcgttgtccttgagcgcaatctggagctgactaagcatggtgtgcagctgcatcaggtcctcagtttgcggcaggtaaagctgcgtcatttgttgttcttgtatgccgttcatgtttgttgtgtgtgaatgtgtggaggtgacagaagtggcatgttggagatgcgactggtgaaggtaattttgagttactattgtatagtgagctgaatttaatgggttcgtagaaactgctgtaggggtgataaaacgatcaaaactggcaatgaatctccttgtgtcgttttatatccgtctgcaacatttgggctgattctgggtccagaaacacgaatttctagacacctttgcgctcctatatatagaacatcacctcccgcaaatagagttggtctccaatatggctatattgcaatgtggattgcacgaaagtattgtacagcatctcaccggttccgtactcggtttgttgcagcagttatttgcggcagctggtcaaagcagtctgtcccaactgtcaatctgttgttggactctcggaatagcttcacggaccaatctgaacacttgaagtccagttggactcagctaggccagttggagcccagttggagcccagttgaattccagctacaagtactacaactgcgcaatgacacaactcacaatcactgcaccaatgttactggaacagtcacagacgggcacagagagacacagccagacacagacacagacgccgcagtcaacactcctactctagtctcgcaatcctactcctgcgacctcaatacggtcaccagagaaagctatacgctcaccaggaccagctctgacttgagagatggactcgaatgtggtatggagggttggggattggaagatgctctttatgacaagttgaagtacttctggctctggtaccacaagttcataacagtagcaccacagataacaccacagacaacaccacagacaacaccacagacaacaccacagacaacattgacaagtgcaattggctgtcaatggtgatgatatcttacttggtagccttttgctctccacagtatgtaccccgtcactcaagttgtatgttcatccgtcttcactagaactaccggtaatgaatcctgcttcattccggtacccctcttcatccggaaatccctcttcatccagaactgctggccctactccaatgtagtctgaagtcttatccggcgacagattacgagcactgccaatttccgagatgcggccggatcttggcgctctttgtgcggcaactgctgctgctgtcactgctgctgctgctgcacaacatctgggactgcagatgatcctgttgggtgcctgcgtgcgagcagtggcatgtacagtatgtactgtacccctggtttgaaaatccgtctcgcagcgtggggacttgttgattagaagtcttcaccagtgtggttgtaaggatgtttgtcgccatttcacgatacggaccatcccctcgccccatcattaatattaatacattaccaaacctatataccctactccctcttcttaaactgcaacagacaatcgtcatcggggaagattgtggcaaacacacgcaccttttcactgagaggcgtcaccttgtgtgtaaagtcgaggttcatgcaggcctttccaatcatgttggtgaagttcatgagcgcgtacttctgtcccagacagtagtggggcccggtgccgaacacgagccagttctttgcgtttttggtgccgtctccgtcaggcagccatcgctcgggcacaaactcgtccggccgctcgtacacctcggggtcatgcagcgaggggtagaccgtggggatgatcatggagcccttgggcactgtgtaggtgtccgagatggggaagtccttcttggccacgtagggaaccataatgacagggggtcgcagccgcagacactccttgaccaccatgttggtgtaagtcattttctcggtgagctccagcgacaggggtacgttggggtcacctcctcgcaccgccagctgctcctctcgaatcttggcgtacacgtctggtcggtcggcaacaatctggaagagccaggtggtggcggaagaggacgcgtcctgagaggcaaacagaaatgtgaagatggtctctgaaatctccttgttggtgaactttcgaatcttcttgttgggcacggtgccgtggtcgctgtcaaagtcccggccgttcatgatggcgatccaggcgtccatagtgcaggtgacatctcctccggccttgatgtggtccttggccatctgggcgcactttgcgaaaatgtccatcaccttgtcggcggcctttttgccgtaccaggccttggtgaagggcagaatgatggggaagttgacgagctcgagggcggcagtcaccaggtagtagtcgtgggcaatttccttgatctgctcctcggtgatgtagttgccgcagaaggttcgcagagagagcgcgcagttgatttctcggaaaatgggcatgtagggcacgtggccgtccttgctcatttcaacaaacttgtcaaagtaggtgtcgtagatgccctcctggatgggcaggtacatgctgagggctctgttggtgaagaggccgttgagacctcgtcggtagtcgacatgggccttaccgtccagaaagacccagttggtgggccgcaggattttaatggccacgtccaccacacagggcttgacgtatgcgctggagttgaagatcttacgggtcaggtcccgatcagatgcgagcaccacaaacttgtggaacacagacacgcagctgagcgcccccgacgcccactgggccttgtatttctcaaagtccgggttgatggagtccagaaatgggccgatgattggccacattttcagaggcgggccggcaatggaccccttggacttgacgtaggaaaactggtcgtaaagtagagcgattaacagcaccgttgcggccagtgtgccgaacccaatcgtgtcctgggtccacgtcagccattgcacaatgtgcgactccggttgggtagcgttcatggtgggcggagttgtgttgtggtggtggtgtgagagagagaagttgtgtttatggtgagattttagaatgggctggagatggtatatcttttttacagaggtgcgttttaggttcccgcctaaaattgaggggggtcggatagggccgtattttgccggatctaggccggggattgggactcaaagggataccattttgttcgtcacgtgacgaagaatccagcggtggtgtcccggtctccgtagctcgtctccatcacgagatatagtctccccctcgtccatatcccttgaacccaatacggaaacgacgtaaacgacacaagagaaataaccttttttccgtcacagaggcatgtacacacaaaactctacagggacgggaatctaaaagcggttataaattaatcacttcaatctccgagaagatctggtggtggcaatatgggttgtatgagcacgagagcaagttgaaggtgttcggaacagtgtccggagtagtttgcatttttcggatttccaatatcttcattttcggcctccgagtatgagagcaatttctactggggcaccattggaccacatttggtctgtggatggtgtggtggttatatctcgaaaatggttgtaccattggcttcgtctcgtgcgtgcggttgtaatggtgtgtttctttttgcaatctactcgctatttgctcctctggcccatcatgtgattacttttagacggttcagccacgcgtcttgggttttcctatttcgtttttcgtttttcgttctagcgaatatatttttcgtttttgctgccaactacaataaacacaataacccagcaatttataggtgaataggtgaatcggcggctggtgaatcggcggctggtgaatcggcggctggtgaatcggcggctggtgaatcggcggctggtgaatcggcggcttgcggcggttttggagtttggcggtttggtgatttggcgacttggagcgagcggcttgcggcggctcaagatggattcgagagtcaaacagacagagatgtattggatagccgaccatggggtggatagtaggggtcacgtgacagccttggtcccccccccctctcccttgctcacgtgactcgtccactgataacgtcacgcgatttcttggctcatggtatccgactacctgtactaacttctcgtgcttctcactggtgctggattatcaccatacagtgtgggaccaaacgggagcatgaatgggaaatgaatgaggggtaaaacggtatacgaggcgtgtgcctgagtcggtcaatggggtttttgcgacttgtgatggggtttgggctactctccgccgtttccagtgcaatctatatacccttacccccgtctatccccgacacaatcataccatgttatacaataccggcatgtttttggtgattacttttttttcaaactgtcagcgtaatgaagtattattatccccatgacaaatagtgtttggaaagttgcctgaaggatgttgatgagggaaccaaacgtcggcttttgtgggggtttggaggaggtttgtgggaaggtttttggtactattttgatcgtgtgagtcagaggaactcgaatatattgttattatcgccccatctcttctatatgtccgcgtcaagacaccctgttgtgctcgtctctcgtcgttccggtcgtaaagccttgggccattagactcacactagaaatctcatgcagcctaatctggcgtgacgccaaagtcaaatatatttcttgtccgagaaatgagctgacaaatgcagtaggacgagcagacacaacgccgtgtcccgttggtgtttgggcgtgacgtgtggtggggggaggaggtggggggcgtgtcacgtgaccacgatggcggcgggggcggggcggagcgcgccgggcgtctccggtgtgcatctcacgtgaccgcgtgaccgtcctgtgctgtggttggaaacttgtgattatctcctcctcctcatcggcgttaagggttaggttccggaccggaatttgtgccggttggaaatcgcaaaatgcagccaacggcgaaaaccaagacaaaacaaaaactagacaaaaaaaacaccacccaaaaaaaaaacacccagaaaaaaaacacccagaaaaaaaacatgctggaaaaacgcacggtgaaaaattccatgcggtgaaaaaaaatccgtgcggttatcacgttgcagccgaggtagaaatacgacgcagttgagagcacactacgacatgagttgcaataaatctacttgtcgtgcaaatactgtatatgctgaaaatagcgtactgtattacgacgtactcccctcccctaccctaccacaccacccacacagcttagtcgcagattggcaagggttatggtgagacaggaaaaaaaaccacaagccggtctcctctcaaagtgtctttccgccctatttcgcacccaaatattcctgatagcgtcatcagagttcgtttagtgggcgccaatatcggtttagttgagtgtccgatgcatgcttaattgattgacgcgctgcatgttctaccagggtgcaatatagttagttggttggtgattggaggaggttggaggatgttggtcgcgaggaaagtaggggcacgtgaccagtatattactcgggcacgtgatctccccctggttgttgctcccaaacgctgcggtcgtacactttcggggtctccaaagttggaggtctatttagcgagccaagcgaggtttgggagtgtattattgagaggaataagtccaagtacttagacatcctggttgggacgtgtatatggtgagaggttatgagcgagaattagtgggcgagggcgagaagtggtgagcaatatatgtcacgtgactagagtggttgttccaaaaaaaaaaaaacaacaagatctcgacacacatcaaccccattaaattccatcggttccaaaaagattacagcacccaggattctcgtatggtctcccactacaatactaactaggctctctggtgcttgactatggctgatcggacgggaagccgtattttcaccaggatatggcctggaccaaacctccgatacggggaatcgaaccccggtctccacggttctcaacatgagagcgtgatgtgatagcccctacactatatcggatttttgaatttttggagacaatgtactttattatgcgacgtttgacttttcgaaaaagctgtaatgaatcattagaataataaaaaaaaaaaaatcaactagacgaagcgtcgacaaaccaaccgacagcgcctcgcagcgcacatcgcaaagattcagaagtgtatgatttatcgaacgccaataacccggcttactacaagtaggtatatagctgtaatgaatcattagaataaaaataaataaatgaaaaaatgaaaaaacctcgtaatgcaggcaatattactgaggttatgggtacgagaagattggccttgtcatggagagtccattaatgctgttcatgaacagtaggtttcatattggtggaaatataagcgcttgaaatcatgacaaatttggcttgattctgtgatgatcaggaaatggtcagaaggagtatggactcaggtaaagacgtttaatgtgtgttagaaggtgtagagaactattcggaagagtagtaactgttgattcaaaagtcccctgacgacatggacaaatggaccctccagacagctggcattgagacgactcactgttagagaagcaaaaagtctgtcatttagttagtggagtcccatgatttgtccttctagctgccagtgtcagagaccgtactcagggccctctccctacatagtaatatacctcaccggaccaaaacagaagcaataacatgttaccaatgttttccactgttttatgaaccatattcacaagtcgccatcatcatttgaccctttttctcatgtcataacagataccaattagacagttacttcagagacattcatcaagtcttaaacatgtactattacaagtaaaaatgctctatagtctcctgatattcatattgacatactctctcgtgtgtacagtgtacacatagtcagagtatgtcgaaactaccaaagcccatagaactcgatagagaaaaacaggcgaaacggggacttgaaatccagatagaggtgccccgaatctatctatttttcaattcctttctccacaattcttgatgtttagtcagtcagcaacaagtagatggacagcggttaacatagacgatatcagatatgtctctgaaaaaaaacgcgatggcggtaacacatcatcaagactacaagtaggcgccctagtactacttgtagtacagtaaaatacaaataatcaattatactgttaaatagtgttctcctcctgacttgctctcacacacccactcccgagtatatggtacccaaatactcgtccaacctcttgccatctccctcgagcaaatccatcagatacccctcatccttgttgagaaactccttgagcaccttctccacggtggcatcactcaacccatctccataccgcactccagggccagacacattgtaacacgcatccatatgggctctctgagctccagccttttgacgagccaacagaaagtcgataatcttctccagagccagagagcgaagatcgcccttgtcacgtggtccgacagagtagtcctttactgagtcactcctacgacgatatcgggagcgggatcggctacgggagtatcgatcacgggacctgtcacgtgaagagcgatcacgagatcgaggcgaccgctcgtataatcggtcatgtgatctgtcacgggacgaccgattatatgatctgtctcgtgagcccaactctctcagtcgctctctcagccgctcctcttcatccttctcgcccaacaccttcttctccacctccagcttttgtctctcatgatcctgttccagtgcctgctgtcctagtcgaagctctgtcttgatgagacgtttctccttgtccttgagttctgtttcaaatttctccaagttctcctctcgctggagtctggcctccagctcagaaatcataacgtccttgcggtaacattggctcttgtaatgttcatagtctgttcgcagagttttgacatcagacaccgtggcactggagagctgaatggtgagatcctgaacctgttgcttgagctgctgaatctcgtgatccttggtcgcggtcacgtcgttcagttctttctccatcctctccgtcgcctgtctcaattccacatctttttcttcactcacacgtttcaactgttcctccaattggcccacgagcatctccttttccccttggccctcctcatactggctcttcaacgagtcaatctccacagatcgctcgttgagctgctcagaacactgctgaacgagctcctccacctcccgaacccttgcctggctctgatccagctgtgtggtgagcttgcaaatgacctcaaacagctgctcctcgctcatatccagcggcacctgcatgttgaacttgttcttggtctgtggggtctgcagcaagtcaaacttgtcgcgttgctgctttctggccaaacgctcacgagccagcttcttctctcttgtctgctccttgtcaacctccgtgcggatcttctccatgtgattgggcgcggttcggagatacgaatgggccgcaggctggttcctgtcgttgtaggagctgaggttcgaacgacgggtctcagacgcctgacgtctcgcattatccatcgcactggacacgtcgctgccatggttgtttcgggcaaagttgtagggctgcttgtggttgacaaacgaggcgcccacccgcacgtcacgggcgtcggtgtggtccgaaaagaactccggcgaaggagggtaagtgggggtcttgttgtcggtcaaaaccgtggtgggaagaagaacagacggcttgtgtggctgggacctggactccgaatccgcatagcaatcggtcgaatcgagctctcgttcagataaaatgttggtaatgttggggttgtacgagccggccttttgtgtcgtgtggctgtcgaacgagttggaggtgttgctgcggttgttgacctggctggcggctgcgttgacatgtttgtttgtgctgattccgctggcgctcttctgcggagtcgaggtcgacgtgccgttcatgagacactcgattgcagcagaggtatcgcccgtcatgaacgaagccatgtcgtgagaagcgggagaaaacgccgcagcaggctcagagacggacactgaagcagtagcagcaggcgcagtagcagcagacgttgaaacagcagcagctgcagcaggaacggatggcttcattgctgacttgggaatcgggggtttggcagtagtgttcttggggatgttcttgggggtgttcttgggagtgttcttggtgttgttcttggtacttgtagcgttattggtacttgtagcgttattgacgttcttggtagagtccttggtggtagcagtcgaagcctcagttggggccttgcgaaacgtcttggcggaagtaagcggattggtctccatcttggcctctgtatgcttcatcttcttctcctgtctctgcttctcgaacagcagcgccttgtccttcatggtgggctcttcctggggctttttctgagcgttgacgagccggtcaatgtccttgtcctggagcacggaggggctgtctgtggtagtcatggcgatgtgtgagagtcgattgtgtcgttagcaatgtcttgggcatttgtagccggctgtctctcctttataatcgagcccacgagctggtgaggttgtttgaaatgtgcactggtagtctgttgttgtgatgcatgcaccaaataaagttccgcgttttcgcgtttgtctagatgtgaacaaaacacacattgtgggataaaacggggtgcagaagagataggacaacttggaaaagaaaatatgaaccagcacaccatcacgatcaaaatgataccccaaacacccccagacaacccccacaacccccacaaacttaaccccccccatgtacacccccacacacaccgctacggacaaagacacaacatcagggccaaataaaccacgtgaaaagtggagatataggcgattaacgcataccattggaatgagcgtgatccaaagaacaaatatataccctcaaatcgacaattaatcctacaaaacagctcatattaggacatcaaatctaccaccaatctccaactctgccacacgccagttcgaacctcgtctgtgacagccccaatccatttttaattaaaaaagaaaaaagaaaaaagaaaaaagaaaaaagaaaaaaaagaaaaaaaagaaaaaaatataaaagaaaatttgccgtttctcaaacagccccaactacttgtagccccaaataatgccacacacctgaccaatttcattgatattgcaatcatctataattaccacctacattacttgtatggtacagttctgtacacaaccccctcccccttctctctccaatctactcgcatttcattactataaaaccaggccgaccctctctcatggccccaaccaagtcgttctatatatacaaagacctagaagttagtagaaaaaaccaccccgagacagagacacaccaatgaggcaaaaagtacaagtaccaccccacaagccgtgccacacgcctcagaatatcaaaacaggcccacattaggtaacatgggacaaaaaacaaactggctgctgccgccgttgttccagacagcaaaaagaacaccatctggaccgcaaaacaggcaacaagcctgctaaaaaaaaacctgtgttgtaaaaaaaagaagaaataagagctgcaaaaaaaagttagtcacaaatcgcaaaaagtagacggaatgtccagtgttgtaccaatatggtaatcgggaaagcccattctagacgacaagaccagccttgtcaacgtcaaacgtcggagcagaagccgttgtttccttcctcggagcccacctgagcccttcgctcgcgctcctcgtccatctgctgctgcaacatgctcatggccagcgccactgcagcctccgagccccgcattaacagcgtgcgctccctctcgtactcggacgagatggagatggccgcgccagaccgtttgcgcagctcccggatgttgtcgccgcgccggccaatgatgtagccagcgaacgacgcggggataattgtggattggacacatgcgtctgagctggacagcgcttctgcgtctccaccatgatccgacacggtagcctccctatctgtgtctgtgtcacttcctccatcctgatggcggccccggtagccggcgaaagacacatattctttatcttccgggtcctcgcgtagggtcatactgccctccaggctgcgcgggttgtagtaggccacgaggattgatttgtccttttcttcaagcagacactggaccaccgtgtagacggcggtctgcagcgccagcggctcgccctggatctcgacgatgcgctcggacgagtggggcagccggtgtttggacgccacaatgcgcacgccgtacttggcttggatggccttgatgcgcacgccgcccttgcccagaatcgagcccatgcgctggtgcgggatgagcaagcgcacggtggtggtgccctgtgggcctggaggcaccagattgagcacgtagcccgacggcgggtgtgccacgagtgccgcagccgccaggccaatggcacgtgacacaccggcggcggtgccggcaaccgacaggatgcggtcggggatgccggcgacggactttgtgacgccggccttgactttggcggcgtcccgaagtccggccacggtggcgccatctttgccaatgatgacgcccgcctctttcgtcgacactagggcccgcagcacgagctgagttgtgtcgtcgccgagcgtggcggggttgccaatggggtcgttggcgaagctggcgaagttgccagcggggtcgacgttgtcatggtcgtggtcgtggtcgacatggacatggccaaagtcgtgggtcatgttgaggtggttggcgacgctgttttcgttggagtcagcgacgctttcgtctcggacgaacattgcttgttggaatctgcgggtatggaacggcttctcgtcctctacgatgtggcccaagttgtacggggccgacagaggagtggaacgggcgtgttacctgatcacagagtggttgctggggggaggggggatgtaagcagctcgagggggggagttctgggggctgcctacgtcctgccacgtctggtggagaggttgaagaaggtgttgtgctgaaagagtggtgagggagaggtagagttgagttgacgtgttgtgttgtgttgtgttgtggcacaagtgacacaaaagccagattttgggacctcgtttttaattatgtatatatatatatatatatgtaaggggggtgcccccgacgttgttttctgccacttcatttcttcttcttacactctactacttgtactttgtttgttttgtggcatgtgctaatttttgggtgccacgagatggagggtacggtacgagtacttatacgctgagtgtgagtggtggtgagttgtgtggtgtgacgtctgagtcttgttggactggttgcttgggttggtcacacagtaggcaacaacgaggtagggtacttactctactctcgtactactactactctacaccaccactactctgctacaaccacaatgcagaccgccgcagcagtccacccaccaccacggcactaggtggcgctaaaagcgacactacttttagtttcccgctagcgatgcggcgtacctggagggaccaatcggtgtccagacgtgggtggccggagtcacagtcgcagccagacggggtgtcacacacagactccgcactcaaatctccgcctttgctaccggagatcggagtttatgcgaggtgccagtggtacacagtggcggtgccagcagtgacatccaaggaagcggcggcgggctgagagacggagaggtggcattgaaaatgctcgtctggtagtcactctgatctccgtcctctgatctccgcatgccaccgccgtacctgatctgtctccgactaaccctgtatctatgatagccactacatacgacccgatctgactgtctgagacatgtgagacatggataagaggatggagcggagaggaagcaggggagaaaggggaagggaatgagccgggcgactgtgattggacgagagccggaaaacaagccatacgacatccgatggcctccacaaggaccataccatggtgagtgtttgtgcaccttaaccatggtacgtcctccacgttgagctgagacatttcttccgagacattgcagttgctccaagaatacggtacgagtaaggaccgtgtattagcgggggacgtgtggatttttttcttttctttctctttcccctttcctccctctcttcttattcttccccttctccttcgttttcttctttctttcgtcttcgtcttcgtcttcgacttcgtcttcgttctccgcttctcctcttctccacgtgacttgcttttatgtctggtcttgtctgtgggtctgtatcagaggtctcttcagcgatgtctctgtctttttgcacctcttggcagcaacgttactttcgacgatcggaccgaaaagcagttcaagctccactcagctataactctgtgttatgattcgcaagattacggcttctagaagaaagacaccgaagaggtgtctgatcccggccggagaggaggtgcagatggtgagggggttggcgacagagatgggatcccgttatcaacaatttggcaccagacaggagctattggtggtatgaatcagcacgttatgctacttttcgttaaagtagccccctaacagcagccaatgacagagttacagtacaagagatgaaccagaaaaggtttagctgtgaacaaggtgagtggtggtggtggaggagttggtttggcggtggtttggcggtggtttggttttggggtttgatggattggttgcttggtggattcttttggtgtatgactgcttggtggattggtttggtggttggtggtttggtggttggtggtttggcggtttggttttgatggtttcgtactttcagccaaacacttgagcaccatttgacgctgcgccttggccttctacgatgatctggagactaatccagttattcagttcgtgctgcaaaaagaaagcatggaacatctgtcaatcttggtagatcatcggagaattaggtggaaggagatgccaagacagagaatgagagagtgagtacgtacgagaagaagcaaatctgggactgagaaacgttagccgtggaccgaggatgtgccagagcattggggaacgagtgttggggaccaagatgatgcagtcttccattcgtcatgcccactaagctcgctgcgctcatctgtgccttggttgagtttggtggtctccagacttcgacactgttttgaacggcagacaaagaatctgtgccgtagatccagtcatgtgttgtttttaaacacagcaggtagtggcgagcctagaaggtgattctggaggagatacaagggatagagcaatttcgcaagtcgaagatttatggaaaaaggaattcttcgaattgtgagagagtctggttgacttggacgtggctcagcctgacatgcgttatccatgtgctcagctgtcagaactgcccgccaggagtccgtgttgttggtcgatatggtgagacggcgagatgctgaaacatgggctcaccgtctcagggtgcttttgcgggattatcggtgacagaagcaattccatgtacagacatgcggagtgagctggtcttggtggtcagagttggggttttgctacagcagcttgctccgagtctccagtaacccattattgggcatggggtctatgagctctgaagcattgtttcgggtgacttctaccacatgactcacccatcctatctgtcttgagtccagacctcactggttcagccaatgcccggactgggccatggcacggaagttcatactgtgagttcaatccttgcacttggaaaacgctccactacaccataacattgtgtgcttatagtctctggtcttagcatttcctccacctccgtgattcctacaagttcaatactgtgatgaagttgccgggataccctacaccagccagtacagctttactcaacagttggaacccagtcgatttaaaggtgataaaatgtcatgtctcacagatagaactgtgctgctgtcgagagatatggccaccacacctaggaggttggatcatcggatacccagctcgtttctggccaacacttgcttattatggtgttgatggagctgccagtacaagtcggcgttggtggtgtttcaaactgtgggtgcagagaagcgcaaacgcggttcttcattgagttgatctagatggatatgttccccgtggcagaatcagacttgtggctttcctcaaaagttttggtggaatcaaaccaaactccgaacggacattatcgaagagagtgagaatttcattgtcagtctcactaagacacgctccagtaacctcttgtgggcaaaaagaactcgacacggtgggctacaaaagagcctgacctcggattgcaagtaaaaggcacattgagggctgctcaaggaacagtcaactaaccatgagtttcgtgtttcgtcatgttaagtagcgtactgtagcaaggagatgtcaatcgatcggagagagagttcaagtacaaggcgatagtatcgtacacttgtaactagtcattggaagagctctttatacaatatggaggcggagggaggccacaccatttgtgaatacatgtttgagcacagctgaattgtggattcatctggcggggaacggctgtttgtagtctggtgtccagtggggcgaccagtgactgataagggatccagctgatcctcacttgccggatgaatacagtattaacaagaggggtcataagaatggctgcaaacatccacatcttgaagaaggaagacacgagtttgagagcttccttgtccacatagagacgtagaccgacaaaaatgactgctgtagccatcagtttgacaacgagagacacatctgaaagggtcggggtttcttgtgaagctgaggcgacccaaaggtgcttgtggaacacggaactcatggcaatctgtcccagcatacactgccaaagagcgacactgagtcgacttgattattgtacctttttaacccgaatcaggtcacgtgggcaattctagaagcacgattaggaggagcgttttggtggttatagtgagcagtagaaattcaggtctacaaactggagcgaaggtggactgaaggattgacggtactgttgggcaggaagagtagttggggagtaatcggggagtaatcggggagtggtcgttttagtcgtttagtcgttttagtcgttttagtcgttttagtcgttttagtcgttttagtcgttttagtcggtttagtcgtattgtagtctcaatcgtactcgtattcgtactcgtattcgtctataaggttgtaaattacactttatacatgtgtacttgtgaatattgaataaatgaaatttatttataaacacattagaaaactgggctctttggatcactgtccgactggacatggcctttgcagtcaacctcctggctaccttcaaccaagagccaaaggaggtgcacatgaaggctcccaaccgagtcctagaccgaacagtttggtttgacatactccagaaccagttcctacaatttacacaggtgctaactggagcattgtgactaccaaagcatggtgatgataatgtgtggtggatctgatcagccaaacagaaatccgtttctctgtcaacagctgaagcagagtatatggacatcgttgagggagccagaacaggcatgtggttcagacaggaggcgcaacgcttgacgttcaatatgtacatactgtactcggaagtgtcagtagccaagttgttccagtgccagatgacaaagctctcgtcattttcactgacaatcagacagctctacaaatcagtattcatccagcgtatcatcctcaaacaaagcacattgctagacgattccactataccagagaagaggttgagcgtagtacaattactgttcagtacatacattcctactggcaaccgactggcagacatcctcactctgaagagcttttggaatttgtatgacagtggatcaagcaccgaatgctgtatgtacaagacccatgtaaatactgtgtacgtgtactcgtgctgaataaaatgaaattttatctaacaaaacacattaatgacttagatatcacttgccggaaggtgttaccataaccagactctttctggatcagagagactcatcaggagagtctccacaccctagtggaggattcgactgagggtggaaactacaattgtagtggtttacgtcaggtactattgggacctggagcttgcaatgtccccgaacgagtacatactgtactcgaacgagtacatactgtactcgaacgagtacttgttactcctggtactcgtacttgaacttgtactgtacccagggactcttctgaacttctccagctacgtgattcaaattcaaacatgcaaattaaattagtacttttgaggggtcagcaaagtgaatgtctttgaagacatgatgtctgatgacatttgaatgtttttgaagacatttggatgatggcacttgttagtctcattcgagtcgttcgagtagttcgagtcgttcgagtagttcgagtcgttcgagtcgttcgagtagttcgagtcgttcgagtagttcgagtcgttcgagtagttcgagtctttcgagtagttcgagtcgtccgagttattcagtctcgttcttttctcattcacgcctcattcttctactgcacaacaccaaccacatccttcagcttttcaggcaaatggtccgggtgccgctcatccttctcatcccggtcttcctcaaccaatccttcacgctcctcatggcttcggaacgttcggttgccccgcaacttccagtaaaggaccatgtacaaaaagtatcccaccagcacgacagagacataattcatgttctcctgggtcacgggcttggtgaagggcagcgagtagacgacgcaggcaaagacagtccaggcaatgacgacaatgttggccacaaggccgattttgccgagccagaaggggccgcgctggatgttgtttcggccaactcggagcagacagatgacgggaacgcagtacgaaagcagcaaaaaggagatgcaaccaacaaccatggagttgaatgcggtctcggaggccatgtaaagacatccgagaatggcacaccaagtacagctcatcaggtgggcgtacaggggcactccgagcttggggtcgacttgggaccaatatttggagccaggcattcctcggtcacgtgcaaacgaccatgtgagtcgcgcctgccacgtgtgggacgaaatgttgcatccgaacgcggtgatcatgagcagcgacatgagacagagggctccggccttgttgttgagggcctggtagtaaatgtcgaggattggcgatccggtggtggaggcgaaaatggcctcgaggttctggatggagaagaacatggagatgacgtagcagaaggaggttccgaacccgatggccacggtcgacatgatggcgatgggaatgacccgttcgggcttgggcacctcttcagccatgtgagtagcgcaatcgagacaggagaagcaccagttggggttgatgagaccgacgatgaacgccattccggcctgtttccagcctgtgttgttgttgaattgcacaaacacaaagtgcgcgctctggtactttcctgacgaacatgccagcacggtaatggtgatggtgatgaaggaaaagatgctgacgtagagggctgttttggcaacgtagggaagcgctcggccgtagcagttgaaccagaacatgaagaagttgagcagctggtatgcaaccagaatctgccattttttcacctcaaatccgtcgtgatcaagcgcgtacattcctacaattccctgggcaatggaaagggtgacagaagacgacgaaaaaatggagccggcccacgcaaaagagccgcacgcatacgccaggaagttggcgtactttttgggcgccagctggagagtccagtagtattgaccgccggaattgggcatggccgaagacagctccgacagagtgatggcaatacaggtggagaccgaggcaatgatgatgattccatagacaatcagaagagggccaccggacgaaattcccgtgatcagcgccgcggaaattccaaaccacgaattagtcagcccaaatcccactcccaaaaccgaccagatggaaaacgaccgctggagttcggccttgtatcccatctgttccagtttggcattgtccgagtccgacgttccggactcgatctggtacgacgccgacgaatgtcgctgggtcagctctgcagaatgcaccgaagaagacatgtgatgacagttggagaggtcaaatgtggttatcgtggtgtttctatatatgcagattttgcagagtttaatagggattagggtttaggtttaggtgtggtgcgttccaaacgcagtttactgcatgtggctagtgctgcgcagtgctgcattgctggttgttgtacgattcaataaataaaatgtaaaataattacaaaaataaaatataaaatgaatattagaataataaaaaataagaatcatgagaattgtaaaactgggtgattgttgacccgaataaatgagtccagtcacttggtgcaatttacaattctaattatttgctgattttttttaaatttcttatttatttttaaaaaatataaaaattcaaaaacaacccccaaaaaattgaacatatccaaaacaccaacaaaccccagtaaatcatcttgagtcccccgctacacatcgaatatactctaaaatgcttcttttcttgtcgaatcgcctttgattggccaaaaagcttctcctgttttttttttacactccattttagcattattattcagccgtgttatctgaaaaaaaaaagtacaatttttttttaactcggacggaagaacatactgacagatctctatctaaaacgccgaatattgtcgttattggaaatatggaaattccagagtatttctcgactttttccgagtcgattcatatgcccaatttcgcccgccgagttcaccacccatgttttctttacttttaattttctacaccttattttaaagaaaagtaaaaaataaaaaataaaaaaggataaatctggaaatcctgtaaatacacaatacatttatataatcatgtgcaattttttgtgactttcctacccacctgtgccctctttatccaatgtgtttctagtgattttttttttccaattcttcaattcttttttttatttttctcacattttaattcttatcatgcacgattatgtacagttgctatgtactccatcctgattgaaaatctttgctgggctgtggaaattctaaaaaaattgcaataaactttggaaagccgttaaaatattctccacgaagcgagacattttttctcatcctaacccaaatccgcagctttttccctccttttttttccgtctcttttttccgctccctttttccgatcataatttgctcttatagccgatgccattatcgtcgctttttattggctcgtggaaaagtttattttgaaagaccaaagtagtcacgtgaactcgccagctctggacgaaatcagatgatttattttttgaatcgaacgagaaaaaaattacaatcgtacctaccaaattattatttttctatgattttcccagctttttccatgattttctttttgtcgataatctcaaattttccccctgacacgtcacaataaagttccatcaacccatgtcaaaatgtcactggaatgagataattaaatgaatgacaaatacgacaaataataggaggttgttatttcttattttctcttatttccccaccattttcagtcattttcagccattttcatatattttcagtctttttttccgttccataatttttttcatttttttccaactccaatttcctctctcctcggcactcagtcggagccgaaacgcaactggagatccgggtattacagcaaaatgcaccctttttttttggggtacaggtaggttgtggctgataaccctaaccctacattaaccctagtagcaacaccaccctattagcctcctcctccgcctccgcccccgccctaaaccgcggaaaccctgttgagtcccctttgggaagtggcagtaaaccttttcgacggagtgtgttggcatattgtgaaccacacaaaccgtgtcgtggttagtttgtgatacctgaccgcacagatagatacatatgtattccttaatcatgcttccgcaagcggtaaaaagttccttgttgagtgcgcatgttgagccggggttttcacatgccgctactaaccacatgtctcgtgtgacccctcacgcgacagaagtttagtgtgatagacgcagacatattaaaacggcgggggcaggggttatgtgtggcgtcgtgtggtgggacgacaaggcgagtgcgatgggacgacaaggcgagtgcgatgggacgacatggcgagtgcgatgggacgacatggcgagggcgatgggacaacatggtgaatgtagtgacgacatgaggaatgtaatgacgacatggggaatgtcggatacatttagatactgcagatgtattcgggagaagaagacggcccgaacgagaccaaataaagacgtttttagactgtttttggtggggattagtgtgggcatggttatttcaaggttgagttaaaactgaagtgacagagataagccatcttaggagatactgtacgaacgggaagctgatacggggagggtgtatatgtggttcttacgtgggtggagagtgtcaaagggttggtttggtgttattgcgcttgggtatttgtaatgtgtttggatgggcgtgcggaagcgacagcaaaggatttctgtgagatttgggggtgtacggaggttgatatgggccggtagaacaggtgcgggaaatttctggtgaaatggtcttatttctgacatttcagagacaattgatgattgaggaattcttcaacaaaacgccaactatttcaagtaatgctaagtaatactaagtaatactaaataatctgactaactcattactcgaaattattgtgtgataaacacctcaaaaaattatacaattcttctcccctagtactgattattcgattgatatcgatttcaaatccctatctcgtctttcagtgaatctgtccatatacatattaatctggtcttgtataaagactgacatcaatcatgtcatatggaacgggattaccagacctatgtaacgagattacaaaaccaatgtggctccataacagggtctttgtaatgatcagaaaatggagaaaactgctgaaatgccaattatatggtacaaatacaagtcttctcctatcgccgctacttttcaatcctgttacaatgacaaaagctcctgtcggacatcaagtattggttgtaccaatacaccaccccaaatgacccagtattaatgctggagagatacagacttcaaaaacatattcctttcatccttacaagtataatgatatgtctaaaaacctatcatctctttcccgagacgttctacagacactcttgatagaaacattgaatgtctcagaatggactgctgagtaatcctactagctcaggagtgacatcagaggatttctcgtactaagtagattcaaatggtagactctttatccaccatatctcattatttgatgtatttatctgatccttctgtttccctattctccaagattacgtagcgcttaaaaagagacacattttaaacgataatgcttaccaaccaattgatatgagctcaattgacgagtatctactatctttgcgctgtctgaaattctctttttcttctccgaaagacgatcatgatcataccgtacaagtgacgtgatagaatcgtgtcatattacagaaaattacagaaactagattcaaatggcagtatggaggttcggatgcgtctgaagcggtttaatgtaccattttgagtgtaatgagatgtgtactttatttttgcaaatttttctgatttttgtgaaccgattgaattatcagaatagagaaaagaaaagaaaagattttttttttaaaaaagaaaaaaaataaagaaataaataaattttgtaaaaataagtacttgctgcacagtaatttatatgtcttgaactgatctaatatactgtttcttatggatgtatttctttctgaatattttcattcccccccccaatttgcaattttctcaaatttcctgcatatatattctccccctacttcacaattttctcaattttcctgaatatattcctttttcccaaattttcccatttttactttgcccactttttccataatcccatttctgtcacgtgtcgtgggtcaaaattttcatctcccaactagggctaaaccctaggagttgcgcgacacgtgacgtactcccaaactggaactcccgactcagctgcacagcacacccaaactctagtgtgtcgattttccaaattctcccttcacacgccagctctgtcgatacactgtaacacagcctagatcaacatgtctgctcctattttcgaccccacccctgaggacattcagaacctcctggctgcccagacccacattggttccaagaacgttcaggtgagtaatccgtggtagccaacaagcgatggattttgagagatggaccaatcaacgaggccgaaacagagagacggaaacgagagacggggatacctgaggcgatggcgatagcgatgatgacgatgacgacgacagcgacaacatgggtggtttggtttgatggaatgatagctggttttagattcgttggattgatgggctggatagttgaatgtgacatgacatgacaagtgtactgccatcaaacgacatgacgagagcaatgagcagtgatttgttcagttcgcggccatctccatcatctccatcagcataagcctgccactctagtgcctctgaagacgttgtttcgtcgtttttacgttgtttttatctcgttggtcgttttgtgtcacttgtgtctgcgtctaaagcggtatgtgaggtcaagtttattgtccctcatgtctggtcagaccacgtcaagcggttcaccacaactcgaccactggcatcatgggctcaatcacgagagccaagaccataccgagtgtttggtgactgttaaccatggtctgctgatgggctcatttgatgactgatttggtaactcatcggttgcgactcgccgatacattactattattcgctcgtagacggattggtcgtcgattggattgctagcctcatgcagttctcctcacaccgcttgtcaaaccgcacaacatccactaacacaggtccaaaacatcccttacgttttcaagcagcgagccgacggtgtcaacatcatcaacgttggcaagacctgggagaagatccagctggctgcccgaatcatcgccgccgtccccaaccccgccgatgtcgttgccatctccgcccgaacctacggacagcgagccgttctcaagttcgccaaccactgtggcgccaccgccattgccggccgattcacccccggttctttcaccaactacatcacccgatctttcaaggagccccgacttctgattgtcaccgatccccgaaccgaccaccaggccatcaaggaggcttcttacgtcaacatccccgtcattgctctggttgacaccgactctcccgtcgagtttgtcgacgttgccattccctgcaacaacaagggccgacactccgtcggtcttgtgtggtggatgatctctcgagaggttctgcgactccgaggtgcccttgaggatcgaaacaccgagtggtccgtcatgcccgatctctacttctaccgagatcccgaagagcccgagaacactgaggaggctgctgaggaggctgccaccgaggaggttgtcgagaccgccgccgctgaggctgctgccgccaccaacgccgacaactgggacgttgctcccgatgccggagccggtgctgccgactgggctgccactgacgactggtccgagtctgcccccgcccccgttgctgcttaaatttgcaccttgtttttgggggttgtaaaataatttaaaaggcgagtaaaatgcgcattgcgtaataaaatttattgaaaaaaaaacacacccaacacaaactgtccgagtgtacttttccgacagttgagtgataaatagaatggatatctgtagatgttccatgatattctcgtagacatagattcaaccagatggatggacgtcatcggccgttcacccgatgagtatagccattctcggcaggttttttattttattttattttttattttttattttattttattttataataatattttattataatattttattatattttattttatttagtaattgttctcgagccatggtcgtcggcccccagtgaccacagttcaattccccgttgcaattttatattagacacctttgtagaattgtttgaaaaacatctataaataaaaatagccacagaaacaaaacacaaacataaatccccacactgtgaaaatgaccatctcaatcttctacataccactccgctcttccctcacaaccgtcacaaacacaaacctgctccgtaacatgttctgtttctgactaagacatgtgtttgtgtcacgagggaccccgcgtcgggtgcggtggggtgagagctctcttgttgatcacatgacatttgttgggacatctctgtgtcttttgtattgcgaccttctgaaacatcttttgaggtctgtcttgggtctgccttgggtctgccttgggtctgccttgggtctgccttgggtctgccttgggtctgccttgggtctgccttgggtctgccttggatctgtcgtttcccgcttcctcaccaacctccacagtcgtccagccaaatggtctccgtacggtcgcctagagccagtgttgtctgtggaaaatggtggagtggtggatggccagaggcaatcagacacagacattgatgtttcacaatcgcaccgtgtactctccagggattaccacaggctcttcaagtcaccactatatcattgagagacttcggacacacactttcttcagcgagtatggaatgtgttctgggaccgcatttcacgagtgttactctttaagagcaatactattgatacccacttccttagcccatccttctcactcccttcagcacaaaagtcctctacgacaagatgacattggctacttgtaacaaatccagtgctttattcttctcagttatagtacgcttcttgacggtaccctgctagtctgaatcaccggagtcatcagagttaccagagttgtccaaatcatcggaagagtcgtcctcggagtcactgagtcatcaacggagtccgactccgcctccttctcggtcttcttggttgtctggatggaacagagtcgttcacctcaggaacacccaagggagacacttgaagatggagaaaggagaattcttgggagtgcctgctcagactttgccctagtacaaatcctggcagacgccttgggaacagtcttggtcttggcggccgctctggactcggccttcgctgcagtcttacgccctcttggcaggagtctttagaatggctctctttggaggccccgtcagaggcactggcacagtcactgtcatcagagtcgctatcggaagcgtaataattggaatcagaatcagactcacaatcggacttctccttcactggaagaagtaggctgaaaatatttgagtgttccctgattctctttaaaggaggttgggtgcatctgtgtgctcttcttggttgactcgatcttgcatttgggcaacagtcagagtcaaagtcaacatccatcgctctcatggactcggcttcagcagcaccaagcgctcgtttcttgacctcctgggcctctgcttcgctgcttccttggctggtgccattctctcggaggctttttaagaagacacccatgatttatggcctcaggcagaagctgcaacaacgaagctgcaacaacgaagctcatactcgacaggcacttctagagtcagtcagttggagtcaaagtcaaccagcggacagatccagcgggagttatttccactatgagtggattttaatcggaaaaggaggaagaggtccacatgagttctccttgattgtttcactgttggagaacctgctatccacaattgtcgacgattctcagccagaagtggtgattttcgattaccatatcggggaagtgtcaccaagagtcccatccgacactcggtccatctcattataaagtcaagacttattcaatagcgaaggagttttatggaacttgtcaatggtactgctgttggacttggctgctttgtggaacaacttctgctaccgtggacttcagagggctcttcagagaactttgcaatgagcttttcaaaacttctcctttgttggtctaccagtattggagtcgggggtgtgtgctatgatgcagaagatcagaacattaaaaagacttccatgggccctctccagagatgatctggcacagtctttctccgacttcttggagcttgcgaactagttttcgaaactaactcctactacaagtaactacctcgagtcagagggggctcagactgagcaacggaaagtggcggagttagtccaagaccgaaagaagacttttttcaactgtcttatctttatgtcttgactctgagtgtttctatagacacgattttgagagctgagggtacaagtacagttggccacagttggccacagaagtacggagacgaccgagccatacaaaacacagtacttgtacttgtacaagatgtaggtgatttattctgaatcatctcttcatctcgaaacctctgacttattattaagtggaagaactgcttgtacttgtgcaagtggtccagcgaccaagagacagtgacgacctccgcctcagaatcggcttaatattgtctattacctccttctacggataccaccaagagtcgaatctcgggttttgtttcatgcaattgtttcatcattgcgtctgctcccaattacttgaacttttgttgaacgaaatcttccgagtcttccttgaagttcatcccgttccagatgtgctggaaatacaaaaattgtagcattttttaagcccaagattgacagagtattattcagaacaaaaacaactacgtcgccttacaaattctccagttgtcgtatttttctggtgagtaattggctattgatattgttgactttacttagagtggcgtttaccactaagtaatttcttggactaataacaaaagaaatgacagttcgaaacccgactgcgacaagtcaggcgacacagaaaagcgggttccactacaagtacagtacataccgtacgagtacgagtagcgtataattcgccatgccaatgatatttacccattgtggtttccattgaaggggtctgacaccgatagctccatccctcaggaccgatgtagcctgttcgacttccaaatccgctcctatattccaagaaaaaaggcagataaaaccgccaggatttgaaaagctcacgtcgatggagtcagttaagggacgagacctacaagaaaagaccaaacgacaacagacctatcactccgacagcaacagtcactcgtctgtcccttctctacgcataacaataacatgtattactgtagatgtacaaggtctgggacgcgggcgtcgagcagaagccagccactattcaaccaaagagaaccagacatgagaaccagacgagcagcaaaacgaggtgagaacgggaagatcaaacaagccggcaatagaaccagaaaacgggtgtggactgaggaaaagggcaaaaggagcatctggcgctgggagtggagcagagttgaacaggttcaacagctaactaagcacattaaggtgcgacttctcttcagtctgttttttccaaagtcggttagtttggttagtttggtttgttcggtttgctcggtttgttcaaatcgatcactttgtccaattcaaatcgatcactttgtccaattcaaatcgatcattctgtccaattcgatcattttgtccaaatcgatcagttcaagtcgttcttcgcctaaaaaacctcctcctcctcaggcacctgaaatccctcctcggtcgagtacagaatcgtctgaatttcccgaatcatgccctccacctgcaccgtgtccatctgctcggcattctcctgcaccaacacctcgatttcgcgcagcttgttgaagtaaaagttgcgttccgtctcgagaccctccaacacctgctgatactccaccgcgtctgcctccagagtggcaatctgttgctgtgctttggctagagcggccgacgatgcttgagacgacccggaggcaccaggacgccgactgacactggctcgacccgaagcccccgacaaacttccagctccggttccggctccggctccagcgccaacaccaaccgagcccgcggcccccgaagccacactcggtcgacttctcacaacactgctccgaccactggtctgagactgtaccgaggttcttcctgacgtggcattaggagtggagcctggggctgtcgacggcaccgtggcgacccgtccagctctccgacccaccgcatcgtactcctgaccgctccaattggcgtcccaatgcttcttgcaatactgcaaaaactccagattgtcctggaaccggcacttgaccaacttttccaccggaatctgccggtcgattttgtgccgattaaacaccccctgcaacaccttgtaattgttgagaaactcgtactccgccttgacgttgaacttcaccttgctcatgggcacatcgccgtagatggagtccataatctggcagtagatggcgcccttgccgcactcctccaccttggagatttccgtctgcaacagctcgttgacccactgtaccagttcttgtcgcgacatgtcgttgaatggagtctgtaatattaccagctggctttttttttggcgtctggtttgtgtactgtacggtgcaatgtcgtgtcactccagtgagaagaggtggtgttttcgtgtggttgccggggcgacaccaaaccttatatacaaaccttaaaacgcgtacgaaaagagggcccttgagacgacccgccgacaacgccgaaggacgggggaatgatgctagcggaaaaccgacgatgggagacgatttttcagccaaatttagggagttggatttttttggccccacagattatgactagggggaaaatcgctgaatatccacgtgattcgggattaaagggtatctttggaaacctgaaaattgggagattccaatgatatcatgaaaattgcatttggattggtttccaggggaatcgaaatgatatcatctctaaatggaatctgacagacggagatggaacaagagatgggctcaatgtgtagattcgggccccccaaaaatactgttaatttgttcccaatcacgtggagaacaaaatgaattttaaaccaccccaatcgatggaatatccacagacttggagactcccttgtgtgaacctgattgcttctacaaaaggtgtcagaacaaaatgtcgaagaacagacgggacacaagatatgggtgaaaaagtgggttatatttgtccatgtagttcaatcctgttgagccagagtcaatcggagctatattggactcattcgatcctgttttattgatatatactgattcaaattgccttaatggaggtctccagaggattgagaagagatatcaacatcgggacttcgattcgattcttctagaacattactcttccttactatcaagtctttgacttatctacaagccttgtatctggtttggtgatgtactgtatctacgtagaacatgtactgtactttgtagagtcttgacagaaatgccaagttggtattttattgaataatattggttaaaatgagacgaagaatatattcccgtttagtctgaaccgatcggaatactcgagcaagagctgtagagtatcaatgtatttccaaagacacagagcaatgtgtagttccatggagagactctagaacttaaccaataagagaggaactgtttttcacaactatttatttctggattcgaagagtaggaccttttataaccaatattcaatgttttagacgccatgttcaccatctaaacagccttcaaccaatacgccaatatgaagaaaccctggtaataaccacggctcaagtaatataacaaatcacggttatcatcaatatcaaaacagactgccgttaatttcttcccaataggagcattactcagctctatggactcacgtttagatatgaatctctctgaacacacaagaatggttttctggactttagggggtctcagaaccaaataaagatacaattatagatagaaattgtacaaataatccatccctgttgaatccatctcactatctcctttcttcgtcgttctggagaccgttcttaaagtctccatatgtgatcaaacgagtgatctgataatattgctgtccttttagaaattatttcattaggaagtgtttcagattcttctcgaaatatttatttccatctaatctcttgtcaatcgatgcattttgagcgaaacatatttataaatatatatatatatattttacaataacatttgatttcggcttaagacgtgatttacttgactttacttgatatggtcaactgtagttcagaagaaaaagtataaaaaaaagtatataaaaaagaaattaatagatattttcgaaatgattaatgaaacaaataaattaatttaaaatataattaattaatttaaaaaactcaccccaccaataaaacacattccttgtacccgttctttgaatccccatcacctgcaactatcgccccatttttccccgtgtcacgtgatcttaccacgtgatcttaccacgtgaccacccctcccgatttaatccgatcccccgcgacttccgggtaaacagagtgatcacgtgagaagataaaatattttttaactcagacaaaactatatcccgcatatatcatgcataaaacatgcacaatgtttttttttaaaataaactcgacaaaaaagcagactgattcggcaggcacagtccgggtaaccggcgcctgcgcagcacgctcctggtcacgtgatttgctccagaagtcgcgtcgatgttttgcttctctttctattccttttttgggtaagtttatgatttttgtggctgcctttggcggctattattctggctactatagatgaggtatttagagctggtttggggggattaaaattagagtgaaaataaatgaataaataaaaaattgaaaaaataccaaaaaaacccaaaagaaatattccggaaaagtcgaaaaaaatcgggggaaaaaaaaccaatgcggaatctcgtgcagagatgcgttttcctgcggtggaaacttgctgctgcactttcatgctgcgcgagagcaacctggttggcattttctgtgcatgtatatgtggcttgtttttgagagttttgtggattttcaaaaatcagaaaaaaaaaaagataattaaagaaaaacgcagaaaaattacaaaaatgcacaaaaaaagctggaaaaatattgtaaaaaacatttcatctaacaattaacatcccattgttcattccaccgcccatttctacttctctaagtccagatgtgtttttctacaaatatatgcaccgcaatttctccgtgcgggggtggcggggatgcaggagaaattggacttttttttggcggaataattgctccgaaaaatcgggaaaaatggaaaaaaattgatagagcgctaatcttgctggagagaaaaaactgaacatatatttatttcatgctatttccaatttccgtcattttccaattcttctcattttctccaaattgttctgtatttaccacttttgccatttttgccattttgccattatgccaaattgttcactcgccctgttagctccaaaccctaaccttaccgtattcggcaaatataccctaaccccgaatctgtcgcgactcaggttcccaaagggtaaaaaaatcaaaaaaaaaaaatccggacaaagactaaaaaaaaatcgcttatccacagatacattttgtgtcaccacctcagcatcgttgaacctctgtgcgaccctatttgcgcgtccaaaaaccgactttctacgcccccctgacctccgaccgtcccaaaccgctcttttcgccacttgaaaggacacatatctcgcactttggcaccccgaaaccagacctacacctcccgagtgtgaccacgacagaccgactgttgcccccattacagagcccgtgttgcccattaccgagctcgtgttgcccattaccgaccccgtgtaaccaccaccgagtccgcgtaattcccgtaattcctccgtgattactgtaagtatcaggctgggctaggatgggagctcaagtgcattactcacacagaagaagagcgatagcagaggcttagtaaagcagtcatcgacactagttgcgagacgacatcagttgcgagaccgaaatcaccaccacaaccaaaaaaacaaccaccacatcacaagacccaccacactgcgtctgtcccccccgacattccctctgtgaccccactacaccacctctgtgaccccctacagagcccgtgtgaccctattactccagctccgtgacccattacaccagctccgtgacactactgcactcagcatgtcctacgagagtccccgacgacgctcgtccatagccacgacccaagggcccttccccatccaccagcgggcccaccatgccaccaacctccactactacggcaaccggcccggtgtggcggtggcacaaagcgtcccgaccggtggcgtccccgtgctcagtcgaaagatggtggcgcggcgcatctccgagggcgagagtggccggctcaaggaggagctaaagtgcgaggcctgtggcaagggatacaagcacatttcgtcgctggcgaaacacctgtgggaacatacgcccgaatggaacgtgaccagtaagctgctcatcagcaaacaccagcaagtgcagcttctggaggcggcttcgattctcgtcagcatgaacgagggcgacgaagacgagctcgaacccatgcctcagctgcagcctctgggttctcttgctgcccagcaacagcgagagcgcgagcagcagcagcagcaacagcagcaacagcagcagcatcagattgcacagaaccagctacagcagctgcaagcccagcagcaacagcgtggcgagcccatgatgcatttgcactccccgggaagctacacgttgtcgccttctccaggccctagtggacacgtgactggccatggtccgggcgcaagtcacggatcgggccacgtgcccaccccgtcacaccacgtgccacacaatccccacggcgcggtgtttgcccaatctccggcggcggcgttttctccggcagggttttcgacgtttactcccacgccaggtcgacggaactcgctgcaatttggcatgagcacggtggccgaggacgacgacgatttcggcacgtccaagagtccccgggcgtctgctcctctacctccaaggttctcgtcgagtctgtatggctccagtgtcaaggaggaggatcgagagagaatggaggaggttccaagtccgaccaagagcgccagcagtccggagaagtatggcgatgagaaggatgatgatgatggagtttttggtgagatggactgatgagcgcacgagcacgagcgcagcgagtggtgcggtttttggttcatctggatgatttatcgagagtcaatcgagagtcaatcgagagtcaatcgagagtctatcaagagtgaatcgatcaattcatcaatgagcctctcaacgagctcaccaacacactcttcaactcacgatgcctcaacgaactcgtcaactcgctacgctcgtttatgagaagacgaagaactctcgttgcctgcttctcccgtgaactcatccctctagcccttcatcagcgccgcctgccacgtcccgtgatggtcgcgaaacaatgcatatataaaccacatattttaatgagtgtatgagacgtcagaagtggagcgggcggagtggcagtagtcacagaatccgacagactcattgagtagagcgaatgatggtggtgtcaaccacggcgtcagaggtttcagggttcaccaacggcccacggctgagtcatctacaagagtcgtcaagagccaataacgtgaccagaagatgagtcacgtggccagaaggagcgaaacacgtgactatcagtcatggaattcacgtaagtcatggaatcacgtgagtcatggaatcgcggaaccacggactatcagcatggaatcgtggaccaacatgacgcgaatcagtattcaatgttagaccgtgcagatcaggtatcaggctgcgacaaggtaagtgagtgtttcgctctggagtactgttgttgagagttgtagcggcgtattgagtgtcctagagtagcgtggggtagtcagaggtcttagagatagaaacgtcagtatcactgaatagtcagcggtattctcgacggtatcttcgagctgggtttatcggaactcttcacatgagttgaatcatcgtcagtccgctctataccatacatttggtatccagcgacagtagcagtctcatttcgagccaggtccgcagatctgtccaatgacatctccagagtggagaccgaagagagcaggttaccatcagccaagctatgaccagcgggtatcatcaagaggtcccataaccaacatgttttaaccaacatgtcttaaccaacatcttaaccaacatgtcttaaccagactatcactccaccattgctcagaccatgaacggtgtagagagttgtagacagccaatggacaactggtcgacaactggaaagggtccttggcaatccaccattcaattactccagtctgagtactggccacgtcgaagatggtcttttcaatgttgtagaggtgagttgatgtagatgaggtgagttgatgtagatgggtagatgaggtgagttgatgtagatgaggtgagttgatgtagatgaggtgagttgatgtagatgggtagatgaggtgaattgatgtagtgaggcgtcttcaatggttttcaaagacgttcaggaacatcaaatgatcctcatggcccttgcctccaacaccaattgcaaacaccaattgccccgctcgtcggtcctcaatgatatcaacaggacaaactcctcctcaacttgtcattgcggatttcaaccgcaccaaatcgtccttgacgccattgaaagagcttagaacattgatcaccaccgccccgccaataacgcatgtctcactttagcgtgatgcctcagcgcaactgtctctttctcagtgtctttgagcctccaaaaagaccccaaaacgacgccaaaaaccgccggagaaacgcaacccgccccgagtcacccgcgacactcccgaatccgcctcccacaaccctcagcccgccctgtcacgtccccaccccagagtcaccaatcaaggcacgtgttgcatcatcgtgcattgccggggagggaaagaccacgacaagggtccaaaagtggtccaattggaaattaaaagatatcactagaaccgcagaacgccaaggattccaaaaccgcttttaacatccaaaaaaaccccctcccacagaaactgacatgctccacctttctcaccatcgtcgactttaacttcacaactcatgcactgcactgcacctttaattcggcgtaaaaagaggttatgagtggaagcgaagggtcacgtgatggaggaggaaatgtgggaagcggttgtttgttgatttttgttgatttgcgcagactttcagaacgaaattgctgatttccgactgtcgattttcgccgactgtcgattttcgccgacgtcgacatcatcttgtcacttttcaactaactcggcaacaaaaaatgctacttgccaacaaaatccaagtaatacggtctttctcaaatccccccaaaactgcttcaaaactgctccaaaactgctccaaaagattccaactcacaagatgaacttttcctcctgtccagacactcggggattccacgtgacccgttcaactccgtcacgtgagtcgatgtgcagcttgtcgttcggttcgtccgtctcgaaccacctcgaatgtcgatcgtcgaacgtcgaacgtggaaccacgtcgacttcgaacaacgtcggacgtcgaaccaccaagtcgtcatctcgtcgagatgagaccaaattcaccagttgaagtatgcagccaaaagtacgaccccaactagtggtgcattagtgcggttttataggtggggaaaaggtggctgtttgggcccaaatacggattttgaagacatatttggaaagataccgatccgagtaatccaaatcttctttcgtatccccgattggtccattattcgccaagttagatgcgaatccaccttctccatctagtgcaacattgagacactaatggaccttagtgcaacctgccaattcatgtcgcttgtgaatggagccaatctggagacaaatatgagcctggtgtttgacttcaacggtgacttgtattcattgaggagaggagtggttggaacctcttatctcgattggccattgagcaaaacgggttggtgtcgtcaataaagggagaaagaatacagacacttttctgtctcattaaatgcagataattgcagctggaattcaagttttggtctttcaaaagatccttctcgtcccgttgtagccaagatggacagtggtaagaacggcgccattgaaagttcattctagagacaccatcgagtcacgtgtctggtcggacttttcagaaacgtttttaatgtatgtttaatgtcaattttatgtcagttaatcaccatttttgaacctccagacctgtgccatgattatcgtacggtttggaggagtatttttgttctacttgtaatttgttgcatcatttgttaagaaaatactggactggggggtcctatttcggtgctggaagatggaatcgagatgatatatatatgagagggtgcaaaatggatatattcttaccaaggaattgttggtggacttttgagcagtactaaaaatcgagttgagactagtttgtggagggatttgttgacattttcacggagatttgttgacatttacttagagatttgttgacgtactcggacatttgttgacgtttacttagagatttgttgtagagcactttgattgagtggatgattagtgccgccgttagttgggctaaaacaaggatatatggacataatcaggtccatattgtatatgaaagtcgcggaacaaaaggtgatagcagtacaacttcttttccagacgaaaatgtctcatatccgaacttggagtaatgctggtgacacttgaaacactcacactgaatccatgtcccgaaagtccacttggaaaagcaatttctcatattttatttgataaagtgataaaaatcgactgaaatatctcaatcaaactaatatcaatctgatatctcttgcagaacaggttctggggaattcttagaacaggttctggagaattcttagcacaggttctggagaattcttagaacaggttctacgggaatactctgacttgtatgacaaaaagtaggacaactgagcccttcaccagagcaaaattccacaccgctttttttcatctctccatatctcctctccacgttcccacatctcctctcatcgctccccgtctcctctatcaagacctacatctacatcaagagaaccccagtaggactgtaacagcgggaaaagttgacttttttaaaaacagaccgtcacaatccatggctacttacaatagatcttgtcccctactcccctagacatctccagccacgtgggaccgccgttctgtagttccaatgactgattactaatccgtcaaacgattacgtaatacgtcagtacaagtagtacaagaagtaaaagtacagtaaagtacagtaaagtacagtactcgtgtactctaccactcctactgccaatcaaaaaccaccattcaaccccgctgttgattactaatcagaccgttttcacatggctcttatctcaactttggccgagctatagtaatcatagaagacaagtttgggttggataacggtcggatagcggttggaagattgtcagagggttgtcggaggtctttcggggctatattgagggactttctagattgatggtttgaaatagttgggtattacttgggttttattttaaccaacggtgatacttgatatgtcataattttacttgaccttctacttgaatttcgaaaaaacttagttgacaaatacttgagataccaccctttactagtggtccggaaaagctccgactccacccctggctgccggaatatacgacgctatacgattaaatatgccgaggctatttgcggttaattgtcgcggtattacttttgaactttagtggtggaaggaggagtcgtcatctcgatggggaatggagatatcgccggagactgttccaaacgagcttctgccggcaaaatgaaccccagttgtctctttcagaattggaatcggagccctcgaacgtccacagagtcgacatgtggggacgggtgctcgaccgcctctaatctataccgaagacccacagaacagctctagaaacagctctatgatagaaggagacaatatggcgatagatattgcattctccttagtggctctcatctccgacatatcatacaatagactgtcgactgcagacagcggatatggacattaataaccacctgtttggtcgtgtgtacggtgcacttgtagatcgaaagggcgcccggagcaaggctggagctcgtatggctctatggcacggcatggtgtgacgcggtatttgtttttccgcggcgtagatgaaggagatgatctagaacgggtcttttgaggtagtttcgacgagaggtcggtttgggggggagagccgaaaggattttgtcagacaagaaacataccattggaatcgcctcgtctcactgattccaacggtggtttcagaatccccacatatccacccaatcgtccacatcccggacccttcactcctctctccaccactttgctgagcctaaatggcgatcgacatccgccaactctgtatctatggacccaccggagtttgagcgatacgacggaggtccgtggatgaggcattgcacggtaccagtgctgtatgagtgcttggagtactcataatctgacgtcggaggagccagacgtgagaggtctggagccgggaggtctggaatctgagtctgagtctgagtctggaaaactagtccattcgccgagtcaccagtccccaatgaccccttcaaccgtcaccaaactcaacctttggctagcgttcttttgggttgatggaaatcaggtttaacaagtccgagcaagtcggagtgagtgagtgagtgagtgaggtgaaaagaacgaagccggatttggtcacgtggatgtggagtgtggagacggaacgaaatcagatttctagagcgactttgggtagtgtgcttctagggatgcttctaggaatgacttgtaggaagacctctagggatgcttgctaggaatgacttgtaggaagacttctgaccttctagaaagacttctagaaacgtcgtaacgtgctagaaatgtcgtgaccgtcctatatcacctcacgtgaccaattctctccacgactcggcttttcggaccgtgcattcgatgttgactatcgtcgtcttgcatgtgcataaccagcctatcgagtcgtgtcgggcaattgccaattgccaattgcccactaaagtcccgtcactagctccctccatcacgtgaccaactcccaccccgtgcgtactgtcctctactctacaatgttcggtctaccggatcaccgcaccacaccgcatcgcatctttgggcgcatcactactttgggccgaaaatgaggttcaaacctgctctacgacggtgtacggtgcattgccgactgcggttgaatgccgagggccggttcggcgtttggtgtgcgtttgtcgttcgatttggggcaattggcggtggcggtatgttgaggttgaggtcgattgtgcgatactacggatgggcccgaaggttgccagaagcgttcgttcggagatagtgatgatgagatgtcaaaacaaaaggagaaaagaagcagacaacaagaggtggaaagacaaacctttttgcatcgatcggggtacgaccatctgtatattagacacataatgttcgtttgacagcgggttctttcaacgggctgggttgacattgcgttaggcggagtttggcgcagaatgcggtggaccgagaagggctaaaacagccgcctgagcgcgcgcagtggccgtctgagatacggaatcgagatacggggtcgccgcctgagatacggggccgtcgtctggggcatgtcacttccgtcggactcggttaatcctgctaccagcgctctgcaaacggtctacatcccagcgcatttgtgcggctttaatatcggcctttctccaggaaacggtggaggtagttttgcattgggtttggggtggaggggcgggagtttgggcgggtgttttggggcgaggggcggcggtgaggcggattttggggtcggaatagagagctggcgatggagcgagcatgtgatttttttttgatctcaaatcggggcttttttggcggttttgtgccgggtgtttggtggatattattatcgcagttgccacaaaaaaaaaaaagaacaatgcggaaaataagcacaacggaaagtgaaaagggaaaaggaaatttgggaaaagggaaaagggaaaagggaaaaggaaaaaggaaaaggaaaaaggaaaaaggagaaatgggaaaaaaaggaaaaaaaaaaaacaacagaaaaaaaccgggaaaaaagggagaaaaaggcggaaaaaaggggaaaaaagatggaaatgaggagaaaaaaatgtagacagaaacataaacagtattaccacccaactcctcctgcaaccaccgccaccacctgactcagcaactatacactaaaactaggttggaccaagattaagcatgatgagaaaaaaagaaagatacaatagtataatctggagatatccgagatatccaccagtccatagaaaggagatatacggactaattcgaccgcaaatgattgtccaatgattgtccaatgattttccgaccgttctccactattctccgacgattctccgacgattctccagcattttccagcattatccatacccatctttttgtttttttttgtttttcgaggacaattgaactaggttgcggagctttttgccatactactttcgctttaggtctgtcagtgcatatctggagtataggtataggtagagcacgggcaaagaggaaaagaaaaagcgagtgagcaggaaaaagagaagcgaatctcagtcacacttgcaatcgaccgtattgagtcttggagtattttcagagtggctggagacgtttgcgacggcaggagtacagaacctatacaagataactacaccaagaacagtacatacagtacaccaagtacacactccaacattccaacttgaacattccaacttgaacattccaacaccacaaccacaactccaactccaactccaactccaactccaactccaactccaactccaactccaactacaccaccctcaccgctaccatgaacaacgactatccaatatatttcgaaggagccaaacgaccggctccggacgaccgctacatctacgaccacacgcagacccaggtgccgctgcaaccactcccacaacagccgctccagcagacccctaacgtgtacccgccgttcgacccgcaacagtcgctgctcttcgaccccagcatcaacggccaaagcctgcaggacctgtaccaggacaagccagggctgttcgactaccccaagccgccgtcgcccccaccggcccactcggtgtcgccacccaaggtggtcaaacgacggcgatgtcgggccatggaggactccaagacagtcaacaactgggaagacctgtcgctcaaagagggctacaagtcgtttctcagcaccgccatgaaactcaacatcaccaccggcgtggcgtggacgtcgctggacgcggcgctgctggatatctggtgcttcaatcagtttgtgctcaaaaaatgggtcgaatacagaaacaagggcaccgccaacggaatcaactacctgtgccgccactgcaagggctacaaaatccgcatccacatgttccccaaagaactctacaataagtgcaccgtcacccagtactccccacacgacccggactgcaccgccccgcgccatccgccggtggacatggaagcgagcagcaagaccgtcaacaaggcccgcgagaacaacactacagctccgccctccaaggccaagcgccccgaacgcctgccgcgcttctcggtgctctacccaatgtactttttcatatacgcagtcagagacaaggaaggcaaggtcgtcagcacaaaaacccaggagggagcaaaggtgctcaaaatggccttctacggcaaagaggtgctggacgacgaccccggcatgaactcccgattggacagatccgccggcgacattttccatctctaccagaaactgggcatccgaaactcttccgaaatgttcgacctgctcattcccctgctcgtctatctgcagtacgtgaaccgcgactcgtactcctccgtcttggtctcgtcccccgaacgcggagtctaccagattggtcacgagacccccaaagaggcgtttgtgctcaacccaccagtcgtgcgcgggcctcccaaaccctactaccacctggaccccaaggtgcgagcgtattgggagagccagatgggcccgttgcattcggacgcggagctgtgccgcttctacggctgcaacccgcgcacttaccagttcaaaaacacgtccgtaaaggacggcgaggaaatgtacgagcccacgggcggcactccgaccctcaatctcaaaaacttccagtcctgggaggaggaaaagggcaagcgggccaacacgcagtttgacgaggacttctttgaaaagtttctcgccgagtctttctcaggcgacaaggagaagcatctgaaccacgtctacagctcgcgtgcggggagactggacgaaaccgcgtccgaaacaaccattgaggagtcgttcgacattgccagactacaacaagtgatcgagtcgtatctcggtaacaccagtaagacggaggacgagaagctgacggttgagggactcttttgttcgacgggaagcgtcaaaaactacatttttgcgtcgaaatccgtctttgtcttggcgtctatgcgtctcaattgtctgttggacggctccaagtacacactcttgtctgcgcgaatgatcgacggcgacgatgtcgttctcacggtagcgtttgctattgtgcagaccgacgggtacaagcactggaagtatttcctgtccaacatgaaggagtgtttcagtgactatttcctgtcacatcgggcggtcacgttcatgtgcaccttcaactctgcactggaacaggctgcatccgaggtctttcccgaggcccagctctgtgtgggtcctcgagatctctgtgcgcgggtcgcagagtacattcccgtggagtctcggtcggacttcaacctcaagttctgggcagcggccacagactacaatcccgaccgggtgctcacggtgtaccatcagatgctcgagttgttgccctctaacaacgaccccgagtatctggagttggtccgcaagctgcacgagctgccgtgctggaccgacgcgtttgccaagcagcgcaagtttggcactgtcgatctcttttgcggtctgtcagtcaacgatgtgcgcagtctcatgacgtatccaattttcgtgtttgtcttctgcgcacatagaatcgtggacgcttctctgatggagagcaaaaccacgggcgaggccgatcctgtggatggcgatccactgggcaacgttcttctgccggcgccccatgcgcggctcatggcgatcgccacgtgctcaaagtactacgaggtgtcggccatcaacggagacacggtggccgtacacaagatgtatattccgccgtcgcagtttggtgagtttgcacaggcgcatctggaggcgtttgtggtgggctctttgacggctgcgcagctgcgaagagcgggcttcatcatgcaggacagtgactttcgagtcgacttggtggagcgaacctgcacgtgcgggctgttccaaaacgcgttcatgccgtgttctcacgcctacacagctattctggccaagggctactcggtgtttgagttcattggaccgcactattaccggcacaattgcaagctgtggctcaagcagagtgattgcacgcgggcggccttctcgaccttgatgcgaggtgtgctgtgttgcaagagagccattgcggagcggtctcagaccaagttccaggtgcctccttggtttgagattcggcagagaggacggccaaagaatgcaggcaagttgctgccgagcatcgaggggttcaacatcagtcactgagcaagtggctgagtagtggacagacggccgtaagaggagggaaaatatgtatttattggggacgaaaataaagaatgttgatgtgattcgggctatcaggactaggtaaatgtcataattgtgcctcatctgaacgtcacgtgactggtagaagctggagtcgtgtgttatctgatacaatcatggtcgaatatgtcatgttgttggcacatgatgcaacaaaatatatatacagtatatatatatattttcctgcatatacattcatttaattataactttgaaagaatatattttggaagtgagattgtgtcgcaaactcccaactaaatctaagtaaatggaataggtaagaattcacaataattgaaattactcggaattttgtacattaatgaatgtatacaaagttataattaaatgaatgtatatgcagaaaaaaaaaaaatacgcagaaaaaaaaatggtgttattttcattgataaatttgaagagattcagtggagctatttatccgtacaaatatcacctttctgccatttctgggacaccgaatttgaacccccagcgtacttttttccttaaataattttcaactaatggagaagaaccggcaagtcaaaacgacaattggctggggagactacaaaacgataggcttttggtgagatttgaggtccgatgaagtcagagcatcattaagacaaggaagatatttacaggaatcccatcttgaacatattagccgagctttggcaaacagcaacttatacactatcttgctcgtattcggctatagggttctgatagcgaacctttatttccgttcacaattcctcattgagccctcgttagacactttacgggacagacaatgggttcgtcagaaagctcagagtttgcttatcaaaacaatatatataatagttgtattgagcagttggggagaccacaatctcggctgtaacagtaggcagatacttgggccaaatcttgcaaggtagcctccatatcagtcacatgatcacattccaaccattatcatcgatgcaattaccatatattgtacatgtctgtgtctgtagacgagttgtagacgaccgtagaagtcttgagaaacgcgaaacgaacgaagaagccacgcgctagccttgggaaaccggaaacgagagcagaaactacgcgtaagtcacgagaaacgagaacgagagcagaagccacgcgctacgcccgtggattcctggcttcctggctcttctacctctttccacccctcttcttcgccccacctctcgttttaccattattccttctcggcttgggtttgtcttcataaaggggatttgaagcaaacgaaacgtcggccagcgtcacgaaattgatcactccgtagtccaacatggccagaatgatctcccgtttgccaaacttgagcttctgcatgatatgtctctggtccaacacgtcgccattctcatgccgtctcacggcttcttcaaacagctgttccgtctgctccagcgtgggcatattttgtcgctccgtgttgacaacgacaatcttgaaatccggcggaggagggctgcttttcttgaaatctgccgctcggggcttccacacaaagtacgtgaccttgaaggggttttctgccgcagtttcgagactcattcgaggtccaccatgtctataggcctgaaccaactgtagatcccggtagatctggtctctgtcgttatacacgccgaaaatgagctgtctgggatgggtccacagaaacgggatgttgtgaacattgaacctgtagatccacgaatacgaaaacaaggaaaacgaagaggagcccaggggtcggtcacgtgatacagaaaccgacggcgggctctgttggtatgctctttgcaccacgaaaccggctcttttcagatgcgaataagtgtggatcttatcgattccatcttcacccattttgcccgcgcagaccgcgtatgctccctgcagcgagatttgcactccgttgggccagaacagctccatgctgcctcgctcaagcaggtaaatggtctcttccgggtacagccagacctttccctgggaatccgaggttccgatcgtcttgaaatgaggaccacgggccacgtcgacctgtgctttttgcagctcgtcgaaccacacggcgcgcacgtggttcttggcattatgtcgtctctcgccccccagcgcgccgtacatggcgtctagcgagctctggagcaccttttgctggtagtctgtatcatcctgttcaaagtccttttcgccgcgtttgggcaagctctggttgttgtcgtggggagaggttgtcttggtgccggagatcgcgtccagaaaactccaatcctgctgctcgtcggcgagatctatggtgtcgtcttccatggtggttgtgaaaggtgaaattccggctgcatgaatattttgagataaacttcaaagtggaatcatcatgagggcggagcaagggaaatttgcaaattagggagggattgggggttattactgaaagaatattggtaccaaatagtagtttgttttctcctgagtattctgagacttttctggaacgtctttggtgaaaattggacaggttggggagaacattcggataaaagatgaagaaaaaactgaaataaaacgaggttcaaatctgatatgtatatttcagatacactcccaacccccctctaagtgtttttacgctcaaataatccatcaatgatcacttttgtcacactctccgtagtcacactctccgtagtcactctccgtagtcactctccgtagtgatcctccccgtagttgactactcccaactaaacgtagagtttatcaacaattgtcaacaaaaaaacgacactccaagagtgcacccgaaatcagattatatctcaaggagccatcaagttgactaaagtactgtagtattacctctcagacaccgttcagacaccgattagcacttttaaattcgtttagaagcccacaaatgaccctcactagttcttcctcacatcaccctaatcttgacatcggctcaaataccaacgccagagacgtgaaagtacaccgttgaaagcgtggatatttcaagcatcattttgtattcaattttggtccctctcgcttcatttgcatccaactttggtccttttcgcatcatttccggggattttgggtgaataatcgccggagggaaatagctattccaaaaacaatcacatatatcaaaatatactcatctattctttgcatctgacaacatcttaccacctattatatatatagtatatatagtataccatcgctacagtacatagaattctgtactatgacgtaattggaatgaatgggaaaattggaggactgttcgagtctgaaaaatctcgagaatattccagaaagacgcggggacccgaatatgaccttttcacgtgactccagtcattgccgcgggttctgtcattatctattttgtgtttttcagtatctgaaaatatcttaactgtagtttgcatttttacttgttcacccaaatctccaaaatcaccgaaatcacccaaatcaccgaaatcgccgaaatctccacctctgcaacacatgactaccaacggcaacgactcgcaaaactcgataggagcgctgggcgccagcattctgctgagtctggtgaccccgctgaccgaggaaatcgcagtcggcgcgtttttgaaggaaacccggatccgacagacgtacgggtgtggcaaggccgaggtgacgggggcccaggcgtcggggccttccaacaccaacaagaaaaaagcggcggacacaaaacgggtggatctgcagagccagcggcttttgccggcccagattccgggcagagacatttttgggcgagaatcggcggccgatagtcagtactttgagtgccccaaatgtatgcgcaaggtggccggagcccggttctgtgctcatatcgagcggtgtttgagcggtggggggcggagtggccggggctctcgtgccgccacgtcatccaactactcggaaaccgcttctcccgccggttccacaagcccagatcgggtgcggactgcttcacccggggtgaagagaggaaagagacagggcacgggaggaggagaggggatggtgaaaaagagaagattgagtgatggagaccggaagagtacgcaggtgagcaaatttttggaccgaacgtgagtccatcaggaggtgatatgaggacgtggtccgaatgtcaccgaccggatcaccactgcaggaggaaatttgagggcgtaatccgccgtatcagacaagctttgaagacttcggaacatacctgtctgtcagctctagacttacatctatgaacagcggtctagggaccaaagactgcagcacaatcccagtgcaggtcatgacatgagtctgttactcgtcaacctagctgtctagcggcctcacaactaccacgaaaggggcatttccgcatctacaaagtgcttcaacttgcatttatgctgtccaaactccagtcctactccctctatgatctggcggattgaagtctacgagttggcctgatctactcatgcttcgaatccgacttaattggacactcctgcttgtggaaaaggagtcgagctctggccacgacacactgaccatctattggcatttttacttagttcgaacggactattccactcatcggtacctcacaggtcacatagacacctcttccacactccacttcaagcacatgccgactatggcagatctccacaacaaatagttcacttacaaagtttgcgggttgttgacctaccagtctttttcagactcaactccacaggttgataatatctttccgtgtctgacattccgtttcacctaccgcctgaaatacgtctacggtcttttcccatcaggacctcggttcgtgaatggccgtagaccttggtgtcttgtctgttgattcccaccaagattgagtcgaccacttgtactgacatgccgaggctttctccaaggatttccatcactcatctggtggagatttgagatgatagtggtgtcaatggcggtgatctgttgactcctcatcaccgtccgattccatagatgggtcctagcactccagaatctattcccccggagaagaaccattcacctattcacttattcacatattcaccagaggtaggaggcaggcgccgcacgacttatggcgatacggcgagggtgaacagcacatcgtagaacgaatccgaagatgatcaagaaagaggaagagatgtacagtatgtacagtactcgcactcgcatgagacagcgcggaggaatacaagtaatcagaaaggaagccggactttccatttacccctccaatttgtagcatcagtctcgctgtagtcaacaaaccgcatacaataccgtctttcacaatctcaggtacaacctacaccaattcctataccatccattcgtctataagaccttccttctcgagtctgtggcaatactaagctagccatactgcaatggcgatacggcagaacctcagcccatgtgctacgcactctagtatcacgattatcgtcaaatggcgtcattcggcgacaatgcgttcgtgcgtggcacttactccttgatgttttcctcgagccagttgagaatgtcggaaatctcctcaaagccgcacgaatgggtgaggccctcgtactggtgccagtcaacgttcttgaacttgagctcgttgatgatgaagtctctcgagagcttgccgtagtcaaagcggatcacctggtcggcggtgccgtgggctagaaacatgggcgtgtcctggttggtggtgttgtgttggctcagaatgtagtccttgatgggcacgtagcccgacagccccacaattccgcccagcttggtctgggtcagacaccccgtggccagcgacacggcgcagccctggctaaagcctccaatcacaattcggttggccggcacgcctgcgtccgtctcttccttgataaggctctccagccgcccgacgctctccagaatgccctcctggtcctgcgccgcgttcacgttggccaattccttgatgtcgtaccacgacggcatccgcatgccgaagttgagcgacacgggctgctgcggcgcctcagggaagatgaacttgacgtggttgagtcgctgcgctttgcgggcctcttcggccagaaacatccatccggctcccgagtcgcccagcccgtgcagaaagatcaccgtggccgtgtgcgccgctttggcggggattcgtactgctggatagggaggcatggtgtagtgtagtgtaggtggagtggtggtggagtggaggtgtagtggtaatgtactgtaatgatagtggtcacttgctaaccgtgttgacaaccgctgcataaactttgtggggcaaaagagtgataactgagagggggggtccgagagaccaccagcaagggacaaatatcgccgaaaatggagagtcgggttggtttgagcaccgcacatgaccccaaacagtccgggcttctgtcgtaatgcccctgatgtcctctaacgccctgtctactccgtcttgggtctgacaaacgcaattcttagacttgtcattggagtgcttggtgcggtcggagtaggatatttgcagtggttatgacaactgtcggccgctacgactacaagtgggaattgtcgtgtgattattacttgattaattaattacttaattaaattaataaaaggtcttatctgcaatctcgtacttgtagtgtggtatgtacagtagtgtatgtatcgtagctactatatatccaatatgctacagtataatccggattgatactaccaccatacctcaatgactctacttggggccttttaaaacacacaaatcaacacaattcggtctggcaatttcaacccatttggccttgtctttctatccctctccgttctcgtttcagatgccccttcctcccccttcccccaccttctatgctcaactacggctatacgaaagtgtacttggattgtggagacgtggggacgtcgaggaagcttatgaattacgaattgggcggatgtgccagtaccaggatggacgaggatggacggagatggatgaggatggaatcatcgtcaatctgtggtcacgtgatcggccgtttggcttttgggccggggattgtttctaaccgagtaattagccgagtattaagcgaggtgaaattgaggtggaaaatggtggaagggtggacgggtggaaagggtggaaaaaaggcggaaaaaggtggaaaaaggtgggaaaagggcggaaagttgacaagcgacgatcagaacagatcggatcagacttgtggcttattgtggcttgagataaactcgcgcggagggcgtttgcggagtctagcctgattggtaggggggttgtcggtcagctgaatcagttcggatcgcgtcgcaccagatggagaagacatactgcgagtggcacagccattcggactaacacgaaacgtttgatgggcccaggcggcgacttgtacgagccacttgtgtgacagctacgtctataccaaaggttgccggattgcagaaggtactccaaccgagatgagacatgttatatctacacgactctcgcttctgacaactgccatggtgcaatagagatgtcaatctcacccagaagtcgacctgcagtcatcgccgactgataacatgacaaccaaactcccagacggtgtcttctcggggttgattttggtcatgatcttggactcgctgacctacaagaccttggaggtcaaaatgaagctgttcagctgctgtaatggacctagcaagacggatcaactaaatccaagccggtttcagtcattgcaattgtctgatacacatcccaatggcaggaacgcacagggtttcaattgacattgacgtaaagaagattcctagatctaccagtacaagtacaagtacactgtacatactcttactgtaccgtatgtacctggcacggtcgactttttctcacataagtgcagtacggcgctctatcaactgtctcattggtacaagtaagcccatgtgcaccgaaaaaccgaacaaaccaaacaatacagtacagtatgtactccatatcgcactttatcatctctaccaaatgacatctgcgagaatcgaactctgagaaaataaaatataaaatataaaatataaaatataaaatataaaacctgcatgcggctttcttttgctgtggaacttaaatacacaagcaaaaaagattaacaaaaaaaataacaaaaaataacattttattcttttaaaaaaagtacgaaacggacaaacatcacaattctacaagtaccataatcattcactcattcaatatccattatttgcatcaatttcaaggtgtttcacgtgaccgctcacgtctgtctgccacgcgcaatctggcacacagactggttccttcaaacctccccagacccgaccagacatccctcgaccggacaaagtctccgtagagactgactgtggttggcaaatcgtcttgtaaccgactagaccgccacagtgccgttttaaggcggaattgggcccgtatttatattttcgcagctgcaatatgggagcaaaaacgagagcaaaaacaccgtgatgtattttggggcacggtgcactggtgcaaggaggtgcaaggaggtgcaaggaggtgcaaggaggtgcaaggaggacaatggagggcatttggagctgtatcaggggacaaaagtgactgtttggaacttttcggggttcaaaatgggcagttgggtggtgagtaaagctccatggtcatgtagtgtctgtagtgtctagtagtgtctagtagtgtcaagtaactgtctagtaactttcaagtagtgtagtcaagtattgaagccaagtagtcaagtagtcaagtatcaatcaagtaactgccaagtagtcaagaaactctccactaattcccattgtacataggtggtattgggtggagcactaatggagaccctgacatgcgacataatggacagaatatgacaatctgtacattctgagaatctctccaatcacatctattagatgatacagctcttgagccagaagtagtatccaaatgatagtccctccttgtgtgacattctttaacaaaacacatcaactaactccaactaaataaagcatagtataataggagggaggtgtcgtcaaaaaggcgtcctgattgctcatcacgtgcaccataaacgtttaataagtccagaaaacctgacggggcatcggttaaccagactcaaaaccactccaagaatttcagtcccgtcgttgccctccgttgtttctttcaaaatgtcaactgcagaacttatactccaagtaattgcatcaagtattaggatataatctctaccatattagttcaccccaagtaactcgcagagtaaaatgcggaccccatactcactcgactggggtcttaaaccccgaatatctagcaaaaaacagccatgtacgctcaaccgatctttatatacacccccacccacgtccattccctgtctcacattccacctctaccgccattagggtcctgttagcgtgctccaaagtacagatatttatcgtccatcgaacacaataaatattgaccaaattgtctcatgaatcacgcaatcctatttattttgtccatacgagtacaatgataccgaattccaaggtattccgtgtcatatagctacaccatttcatatttcaaatctcaacaataggcaaataagctttccgatttctcaacaaaaagttcccacagattattattattattattagatttttgttaaactataaactgcgacaattatatgtcaactagagactgactagacatgatattgggccacaacgaacccttccattgaacgctagggccgtctgaagggccattacgccacttcaccctacaagtatagtagttgcagtggtagcatttacaagaccatcaacaacttttgcgcaggacaggtgttactcatacgcttcggaacccttctaggtccatcctgtagacagaattccaggccctcgttacatttctcctcgaaatcgattgattcgtataaatatgtgcattatgccgggttcagaagttgacatgaccgtagctcctattacagatgggtaatcagtagatagtaatgcaagctcagtaaatgtagcagaaagcaaggtaactacggtctggcgcgtgtgctggtccactcacaactgctgttcgctcactgacaactgctgttcgctcactgacaactgctgttcgctcactggcaactgttggtccgctcactctcgcttcgctcgagttggctcgagctggctcatgtctttacagcccacggaggaacccccaaaaaccacaaggcccccgcatcggtctctctataaagcctcaccggcggcttgctcttcttatcgaccctctttgcctgctccacacacttgccgatacttgccatgaaactcatacaggtagcatgcccaaacggggacacagtgatcttctcctccgactcgatatccttggctccggaaaacttggccttgatcaccagcaaatactcgaccttgtagagcgacgacttggcggtaaagccgctcatggctatcgtgggcacatcctgtcgctccttggcaacaatggagtccttgtccttgggctcatattgaggatagtccatggagagctcaaacttgaagtcccgtgccagcttctggtccacctgcttggtgtttttcaccaccttgcgtctcttttccaccggctcgtctccctcggggttgtatgtgatcacctccacaacctggatgctgaccttgaccagcttgactcttttggacttgctgccgatatcggggttggcggcgaccttgatgtacacctgaatggggtccagcggtccaaacgatgacacgggataggtgtagtcgacatcaactaggtgatctgccgactgcacctttttgaccaccggtaccttgaagctgccaaaagtcgacagcgtgtcgtatcgcttgattcgaatggggtgagacgtgtgcatgatctggttagacccgtatgtgacggtgacaaagatcttgtaggtagtttcgacgctgtttttgcccagcgaaatgctggctggcaacggccggttggtgggcatctcgtagatgaacggaaggtccatggcgacgacggtttcgctggcgcgcccggccgatgtctgaaacagcgattgctcctggccaattagaaacgactgctcttttttgggcgcgttgattccgggcttggacgacggcgcgtggatcgtgtcggttcggtacagagctatcgacacgagcgaaatcttctgcaacgagccgtccttggaccggatctccaccgacccttccaatcgtggccatgacgccgcaatgcccgggaacccgaacacaatgtcctcgtttggaggtccgttgatggacacgtctataggaaacatgaggggggggtaagggtgggggcgttccagctgtcggttgagtaggtcacgtgttgtcggtttgtgtctttggagtcacgtgttgtcgtctgtgtgtccttggatcacgtggtttctttcacgcttggtcacgtgcgtggttctcgcggtgaggttcaaaaataaaaaaatggcgatatcgccagatgagatggtttcatcttgtgcagatttcatgtacatctgtaggcacacgatagttagtcagcaggaggagccagaacacgaggcggggggttaattggaattttaaaaggtgaattttgtagctggaggagcggagaatatagtggttgttttattttttgccaataggagccgaattggccaagttttaacagtttttgtaatttcaaaaatgactgccgttagtgggtattttggagttatctgttggagctatggagggagaataagtgtctccagaacaggttgtgggcggagtagagacatttgggtaatcggggaagattcaatgaggccagggctatctactggagtatttaattcatcattgtgatgactacgggccctattgggttgactgtttcccttttcatctttttttaacaatacttgtactgtacttgacgttactttatgtttcggttattaaactaactatagctgctctccttaacagcaacatattatgttataaaaacaaaacatattactgtattaggcaagtcttacaagtctatcttcagagagataaaaacaaaacataaacatctattgtcacagttaatttggatcacaacacgagactcatccagtcgctcactatcaccctgttggagaaccgttcaagacaaatcccgctttctggaacctacatccccatgccagaacgcccccagtgtctggatcaaaacacatggtctcaaactgaaacgtcatacccaccaaaaatgacatatgaagcctttctccctcctgaaatcccagcagtggaccttttctggtcacgtgacttctctctttggatgtgtctgggttgtggggttgtagcgtctgtagtagcgtctaatgttgacctgtttcccgggatgggaagttgactaggaatgagtgagttactgagttactgaaaaaacagatctattgtatatgaagttgcagacggaaatgtctacaagaaagagccaccggtgatgtttgaatgttgaatgtcagcattgcagttaacagagtgggtaccagtacgctggagtacaagtgctctgacagttgtgcgagtacaagtacaatccatccatccaaccattccagaattctttcggtcaccaaattgcaactcactcccagatcaacatattctttcagcaacttttcacttaatcatattcttccagttcagctcctataaccaattctcataggaacatcgacactttccaaaaatctaatcaaaaccaatcccgacattgtcaaatgacaaataaagcatttattgaaaaaatgaacgctcctctggtggaatttcgccctccaaaccgattttctcacccaaaatcaaacccacataaaacactactccatatattccccctccaaaatcgaacccacaacctcatcaccccaccgaaattaaactttatcaccatcgccatgacaacctcgtgcatatctcctgtaccgttttaggaaacccccaaatagccatcggaaatacagacagtacatattatagcaacgtcttcagggagactccaaacaacttctgtcatctgcaccgccagaaagcgcaatattatgtcaattccgacccacaagacgttttccgagtcgcaaaaggtgtacattccgcccaagtggcaccgcgacaaactagggggaaaaagcccgtcggttgaagagtcgggataccgcgatttcagagtcaacgccgcagaagtggcgatcgaaaaagagatgattctgagagaatacaaccgaaacaaaccgcccgcggccggtgcgggaggtctcgtgaccaaccctggcgccggcgatgatctcgatcacattcctgttttgaagccgggtcaggttgagcatcaagggttcatgggcaacaagaacgacatgagcagtgtcaacaatgacatgaaccgttacagtcaccatggcagccacaattcacctacctacgcggactttgaaaataccgcgcgcaatttcacccactctgaagactcctttccagagtaccatctacctcgacagacctacccggtggaggagttgggcatccctttggcagacgacggcagtgatgatgagtacagacactccggttatgtctcaagaaccggttatgacgaccacaaatcgaccctccccccatctggctatgatcatggtcatggaggacatatcattcatcctagagaaactccacgtgatacatacactagcgactacaacagagactacaacagagactacaacagagatttcgaccccgtgacttacgacgaccacgtgacatatgacgaccacgtgaccagacatgtccccgtggacattgtaccggtggctcattcctatgagcaaatggacaggagcatggagagaactatggagaacaggggcatgtcgagatcgcctgctgccagccacatgatgtctcaatcacccggcctcgatcacatgtcccggtctcctaacccaatgaacatgtctagatcccctggtcacgtgagcatgggcagatctcctggggctggttacatggctcatatggacagatcgacatctcctaaccctgtcatgcctcggtctccggttccggctgactatcgatctgtttctcctcaccttggttacgaaaccagatcaatgtctcctaaccctggctatgatattacgtctgggtctggatttgcatctgaatatcggtctcaatcccccatccccgattacgtcagtccctcgagatcgcgtgttcctcacgtgatgagggcacctgccccccccatcaacacctccttcgacttgtcttctgacgacgagtactctcctattcaatcttcgtcccccagtttcagacctccgttgtctcctcagttggctctatcttctgacgacgaggagatgatgacgattggagagatcaagtctgccatggctagagaggaggctgcactaccgactgttggagaactgagaagcaaccattccagcagatctggtacgccaactcacagtgctcacagtggttctcaaaatggttctgtctccagcacttcctacaacggtcctgtatctgactttagaaccagaggaagtgtcagttcggtgagcaccacctcctccagtcgaagctccactccagtttcagcttccactcctacctctcgagctaaccgaacctgggccaacacttctagatttagtctggccgagagaagagactctatgagacaggagcgccccagttccagaatgtctgagaaaagccacgatgagagtgtctacagcagttctagagacttgaactcctccagtttctcctttaaagatcgactaaacacttccaacgggctcagctcgtccacctcctcaatttccacctttggctacgactccgtgggctccaatgtgtcacgtggctcgttcagatacgacatgtgtgctgctcgacccgggtcacgtgtcagttgttacgatgaggattttggcaatgtcacagtggagactgtgagagaagagagcgagaggtcgttccaggagggtgacatgtcacacgatcagatccgtgatttaaggatgacggctttcccccactcacgtgattacacacgtgacccgtcccgaccggacgtgctcgacgaccccagcatcaacctccccacaggagacccccacaagttgcgtgacccccagagccccacccacgactcgactcacgtgaagagtctgcctcatcacgtgaccccatgcgcgcctccgcagccctcatacatgtctcagtccgtgtctagcacccggcctagatgcattgtgtgcgatgatcacgtggccatgaacgagcgaatcgtgcagaccgaatccttgtcgggctcacgtgacatttaccatttgcggtgtttccggtgttgtatctgtgactcttctcttgagcatatggagcattacattgatcctcattcagacatgttattttgtcacgtggactatcacgagacttttagtcccaagtgtgctcaatgcagttcgtgtattgagggcgattatgtgcaggctatgggaaaaacgtatcacgtggaccatttcttttgtgctcagtgtggtaagccgtttcaggagggccagcagcatcatatcattgagggccatgcctattgcagtccatgctatgatgtgaagacggccgaaaagtgttggcgatgcagtcacgtgtttaatgtcaatgatccgataattgaggttttggatcgtctttggtgtgaggcctgttactcgtgtgaggagtgtggagttggtttgaaggaggagtttacattgaccaatgagggtgttgttttatgtgaaaagtgccaggtgaagaaggtgaagcggtatgcctggcagtgagtggagaagcaggtgagaggaggaagtttggcgaactagggtattgtgacgtctagacattgtcttgggtacttatcgactcactttagtccgagtactcactgtaccacaattaattgcattgatgtgatattggttgtagattggttatattcagagaagatataggacttctgaagagcattattcgtgattcggaggtcgtctactcgattagaaatgtccatgacaagtcgttatactaacgttgacagttggagtcgattgaatgggggatcaagggttcaactcgtgttatccaataccaccaatcgtataacccagtctcatctgattgactcagtctcgcggatctgtagatgatgtatatcgtagctatggccgccatccacgactgtagctgactgtatgactactgtacattatgaataccgactcggctcgatttttctatcacaaaccagagtcgagagagcaaaggctcctcagtttttttcaactacagtatgggtcctgagagaattgtcgacgctcttttggagaccgcttcaagataagtctaccaaagaccgggtgtctcttctaggacccacaaccctttgtgatccttcttcgtccttctcttacctcttttccttccattactctctacaaccctctacaactctacaaccctctacaaccctctacaaccctctacaaccccctccacccccaatctatgtcattatactcgactaatggcaaaaaagaagacaaaaactatctttagctacccgtatctctcagacaacttggtcagttcccggaagcggactatgcagtctgctggtcgacaacagtctaccaattgaagctgaagttcaacttccgcttacaattaagatacccctactctcaatcttccttaccattactgtttttctctattaatgtgcatttgatcatcagatcgccagagagaatgttccatctgcattttacacgtacatcttcttattagttaagaaaattacttgggatttgttggaaaaaagtacgctgggggtccttattagacgttccagaaatggtgaggaaaattggggtagatgaacttattcaaaataccaacgttacctactatgaaattgtccgtaaccaattcagctgtatttttaattttcaaatctcgtcctgaaatttttcttgcaacaaactacagttggtattatacttggattttgactgaagcaaggtgttttttttacacagcgttaaatttcgcaacagagctgattcatgaattggattagaaatataattctatacagtattattccaactactgagtaatcattccttcaacagtctgactaatgctcagttgaccaagttccagatcaggattttttttatttttttttatttttttagtctctcacagagctgctgaaaggcagcttattgtagctgtggaagaaaataaagcacaccattggatttttcatggcgactgtgcaataaaaaggggtcttggtttcgtctctctcagcaatatctgaagtgttggttgatggtccagatgcactcatgttgagaaaagcagtatttaaagcattcacgcagactgatggtgagttatttacgtgaagaattgtattatacgcggtaaatataatcatttccaattgaaatctttttaattggatgagaattggacgtattgtactcggtgatctgatgggctccgttggagtcaaaaacagaagaaaatacaaccaaagttggtatatgatgtgtggagagttgatttacacttacgccagtatttttcaaagacaaacgagaacttggataagttgaaagtgttcagggagttggcggaatctcttctgagaccattcagggtagctaccggatagatagatcgaaatgattcaggatagatagattgaaatgattcaggatagtaaataaaattatgaagtaagaacggttaatataatgatggtattcgcctcattctgacatcaaaactcgtcaatttagcgtcagaaatatgttactatccaagacaacagcaagatggcaacagtaagatgaaaacagcaagagacttaatcagagtagattagagattatttattgctgattttcagaatcaattgcaactttacatgtctgaagctgttctaatgctggaatattaccccttcattcctgagtctgtctcagtactatgactggacatagcgggacaatgtgaagggaaatgtgactcatgaagttcatattcgtgatccaacaagtaatttgaacatgtagaagttcaattttgatgtttctgaatgtattttcctgtcaaagtggtcttagagaaggtgacggaattatgtgtttatggctccaccaaaaatgatatccgaatcagcgacaggagtgcaataacaagaaaaactcgtttggtcttgtctaaatctggtggaatcctttatggatcctttctagtcttctatttcttttattttctactttctgactaattgatcgacttgcccttcacctaagagaagcaagtttgaggagcgatacgagaccaccaatcaaacatctttcctggagtttcagaggcatcgatagaggtattccgaagccgtgaacgcatacagactaatggccctagaactgacgagggggtccgcgtctctatgatatacccagactctacgtgcagaccgtccatgcctgcgaagatgtaaggaattgatgtgaatatataccaggcactagtaggatatgttattgctctctgaaagacttgcacacacttttagtacagtaccacactcgcactgttctaaacgttcgaggtcaaaaactagcccgcaggctcactgaccactcgtcctcctgaatacctcagcttctgaggctttgggttgagaaactgctcgcattcgacgtctagattcactcggccgtcgaaaaagttgcacttttgcagcccgtccacttattccactagattgttccgtgtgaagaggatgattgtctgtatttagtgcagtacgtacagcatggggatcaactcgtaggtctgttgaaagtgtgtttcggaaaaacagtcagctgtagctattgatgatttgaagtgctttagcaagttggtctcgttgcatcacaatactcacctcataaacagccacagtacaacaatgatagtggctccgctggtgttaatagtaggatataggtcattgaagattccgatgtgctccagaagtgtgcaatcgcgtctttgccgctacaaggtaagatctactggttcaagagagaagttgctagtgtccgagagcacatccgggttgtgtaagtgaggttctcaaagagaagttgaacagtacacgcttggttcatgtctgatagtgtagaagagatgggtgacttgtacacactgtacaagtgactgtgacgatctgtttcaccactgtaccatacgcttaagagtaacatatttcactgaccctttctctggtagtatactcatgcttctttctaccaacttatcagcgtatcattgcttctggtgtggacagactgcccgcaaactactcgtgactctgactccagactccagactgctgactcaggtgaactgataactctctctctggaaccgtgcctgcttggaaaggtcctgggtacactagactagaagtttggtgatagtcggcaagtagttcgccaactatattgttacgtttagtggaagaattgacgtcaatatcgaatcatagctaccgaaaactccgccaaacaccaaagtgcaatcgatgatatcgttggacagttaagtatacaaatatcccgcccagagcctgaccagtacgtacagtacaattccacagtaatataatgagaacaagaatcaacttgggaagatggaagacatgaaatccaagtataccgttgaaataagttcttccaatcaccttttttttttggcacatttaggcacatttcggcacatttagacacggaatctacccttcgggaggaggtggaatatactcgcaagtgtgccatcatctctaaaacttgaaagtcctgatatatcgtctgaaaatccgccctccttcaacatgctccctagaccacgctagaccatgaaacatgtgaaacaacccagaccagggttagaaactaatccatccgcacagatttacacatgcacccagccaaaatcacgctcgaaaccactacaagtacctgcctcgaaccctgtctatcaccgaccgacccactgttgataaacttctgcaagggtctatcccaggtagctccatgcgtggctccgtcagtagctccaaacattagcgtctgtccggaagcggcagtgggtctgtcgcagatctcaccgactattgtcgtcccgggatttgaaatgagattggtagggcgtccgtgcgcaggacaaacagatacaggcagaggcagtatcagaaacagaccaatcgacgatagcccataatgacaacgtcacgtgatcagaccagacccgggtatgatcaaaccagtatccggggggtatgtccaaaccagaaccctggtatgaccagactgtatgactcatacactggtgattaattcaggtggcagatttacccgccagtgtctacgatgggtgatgtgacggttggaccaatgtctgtctgtagccatgccaagaggctagtaggaggagaggtggcgacgaaaagacgagagttcgccaatcacggcttgcaaaggtctgacagtgcggtttttttacttgttgggtctgcacttcgaggtggattgaggtggattgaggtggattgaggtggatcgaggtggatcgaggtgaatttgttttgatctaaaatgcctgatctaaacgtccgtctgtatgtctgtctgtctgtctgtctatcgtctgtctatctactatctactatctactatctggtctgtactcaagttgactgactgatgcaaaagataagatgggataagacggaatgtacaatagtgcccaggagtacaattttggtcgatgtcagtcgatgttggtcaatgtcggtcaatttcggttactgtatcaaactggtaaacagccgacctgaccccttcaatccgtcttgggtcataaaatacatcaaacgactcgagattgagtgacgattccgatggtggtataatatttggtccttttaaatatattttgccattttgccatttcgggttgcacattcacaatatatagatatatattgtagctcgactataatttcagtgaagtgcattgtttttttgttttttgttttttatatattttataataacatatacttgtacattctggacatacaaattgcagcagtcatatactattatcgtatcgacaattatgtcaaatactcactggtaatgacattgacctcaccccaacactagagtgaatgacaacgaatgacagcgaatgacgtgttgggtggtgagcgtcaagtttagccggctgttgaggatttgtcatcgattgttggtgcgggcggtctagaccgggatgtggagatgtggagatttattttcttgtgtccggtttgtccggtttgtggcaaattaatgatgatttttgttttaatcgggcttggggaaggtcccctcactagtcggctgaaagtcggccggggagtacgagtacaaggtggtgatttttcgggagagaagagaactggacagcaacaacaagtcggtgctgtacaagtacaatgtagcacatacgagtgcgatacgtacaatcgactatatactgtagatgtacgatacagtagctaggacggtatagtggtttggtacagtatctacttacagcagctactcgtacttgtacaacacttgtataatactcgtgcaattttgtataatacttgtataatacttgtataatacttatacaaaatttgtgcaatactcattcaatccgtacagtacttgtgccatactcaccatactcataccgtaaaatgcgactcaggattcaaagtcccaccatgtaaatatgtaaatgcaaatatgactaaaatgaaacgaaatgaatcttttctgaaacgaaatcaaccatttgtgaaggtggatggtagacaatctctctctggtgttgataccatcaataaaacgccctccgtgagacggttggaccatactctcgctgccttaaccctcttctccctctcattgccccattgtatcggcttatctacaatacaccgctatcgccccatgtccatgtgtccacctcctgcgtgagtgcatctcacatgataaaagccttaaagcccgcaagtggttttttcgacaaagccaaaaggctaaacggctaaaatggaccctaaagttaaaaggcagacaaagccggcagatcccaaaagtaggccataggccgggtccaaagttaagcccttttttaaacgtgagcgtattgcaatgacgtcgttgagcaggcgttctgagatttatagatctgttgactgacagatgttgtagaccaggttgactgatggatgttgtagaccaggttgactgatggatgttgtagaccaggtggactcatcaaaattgtagactacaaggtaggttgactcatgggtctttgtagacctggtagactcatgaatgttgtttgtagaccaagttgacggtcataggctgctacctccaaacggtatctcctcagtatctccacagtgtctccacagtgtctccacagtgtctccaaaaccacatcaaaagcaatggggccttttatttgttttgccatatcacctcacatccactaccaccaaaacaccatctagccgttcgcactaagtgcaagtaacgttggcattatcggactatagcctagtccacacgtcggctatacggctgacacttgttagtgtctcaaatacgatttgacagccggggagtgaaaaaaaaaacagaccatagttttaggtgctggttgaggactgactgacactatctccagaatcgcacagtgcccgatttgataactgtggcttggagatatatccacaagacgatcactaatcacagcatgcgccaaaaagccgcttcttgggccttcccgagtaggactgtgacatggttgtgtggggaagcaaatgccgggttgaaaggttgtttttgggagaggatgggcaaaagagtgggttttgtggtctccaccacggatatggcggtttcgttgtgatcgccaacgtcaggagattcgattggtgcaattttcgtttcgattgaacttccgtatcccccgatagtcacgggtgtcaatctcccatcgtccggcattcaacgacacggctgagatgcatcatgccaagatacctcaaggtaacataagcgaacaatgtggatggggaaagagagaggccattgtgcatgcgtatggacatggattttgctgcatatctccttatcgtggttgttattggtgaggagggagcctggagacagagagcgcaggtggctggagaaaaggagaggaacgcaaggtcgtttgttggcgatgttgagcatgttggcaatgttgacaatgttgacaatgatgataatgctgataatgctgataatgctgataatgctgataatgttggcgatttgtggtcgacgatttgtggtgattgttgacgtatgtccagtggtggtcctccaaatcatcgcttaatctcaccctatccaagttgccggctaatgctacctttgggttcggttaaaacgactttttaggtttcacaaccggtccaaaaaggcaataataggagagtcagccgcacagtgatacgggatccgagcacgactcatggcggcctggctgggattattgagcgagcgcaactccagccaacgcagcaaccatttcccccagctccccagagccacaaaacccaccgtccccgctctgcctgcttggcgctcgccccatgcaacccgcaaacatgtttgcccgttgagtgtccggctgataccccacatgcatggtgtcatgcaccactggcacctaaatcccttgcacctcatatacaaggtgatacccacggtagcagagtaatgatttcgccatggaccacctcagaagcactctttatgccatcgctcagcgcgagggcatcgccatggccgacgccgaccgcgcgctggcggcctaccagcaccagaccgcgctgccgtctcagccaaatgacagagacacagagacacaaacagactcccaaagtcggacccgtagtgggagagaaagagtaagtgcggagcagatgaaggtagtaactccgcagtcgacacaaacacaactccaaacgacacagacgccgcagtcgacacaaacacaagtccagtcggccccaacaccccatatgtttccaaccaacatctgctttgccaccgcggtcaagctgctggaaacagcccgaaacatggagtgtcgcgagtacattgcccagcccaaaaccaaccacaactggaacgagatcctgcgcacgctcgaggcccagcgacagccgttcgaccagctcgaggacatgtgtctcgtcatccacatttggaacggcaactccacctcggccgcctgcaagctgcttttcgagaagttcccccacagaagctacaaccagtggctgtaccggtacaagaacctcaaggaggccggaggagaagacctggagggagcagaggagagccaaggcagagccaatggcgaggaggagattcccgaagaagtgttccgtactcacttcaaaacccgattcccagacgtctacactgatcgagtgctcgccaaatcgtcgtcgctctcacatgacaaacccgaccgcaagtggtattcgtttgcagtgttcgaggactgggccattgtgctgtgtctgtcaaaccagggcgccacacccaccatcatcgaggccgcacgagagctgcacacacagtttcctcaccgcacgctgtgtgcgtggaataaccggtgtcgtatgatgatccaaatgagttcgatggagttctccaagatggctgcagaggccaaggctggctacgaccacgagcacgccctaaagcaactcgaaaaacgcttcccagaagtttacaaggttcctgtctccacaggaccgttgccatcatggacacagaacaaacctaccacctcggccacatcacaccgactagtcaaggagaataagaaaattcggttcacagatgtcgagaacacagccacatacgctcatatcgcgttgtgccagacggttcaggctgctgcccgacagatggcccacctgttcccccacagatcggtgcgtgcttgggacaaacgtatgcgggtgctgcgcgcagtacctggatggcagcaaacagcgcaggtaagctgctcccagtacagctacgaggcaacgatcgaacatttgcaggcgcgattccctcaggtatacaacgctgagacgtacagacccgaaaacgagagcatggcaacgcgcgcggatgagtcgttcctgcgcaaggccagattcgacgagttcgaagaccatgtggtgctcgtgcacctgtccttgtcccccaccacgacggccaccaagttacacgagctattcccccaccgcacccagcaggcctggagacagcggacactgcacgtccagaacaaagtggacgccaacgccatcgagcatgccaagacgtcgtattctcatgaaaatgtcatgcggcactttcggcagcggtttccgtgggtataccgggagatcaagagcgagcccgtggaggccatcgttaaggtcgagagtccgataatgcccactccgcagatcatgcacaccatgcctcctcgtctggagcatattcctccgccttcccctgctctggcgttccctctcactcctccgttgaacaccgaagagcttccgcgaagtctggctactttggagcgcctgttgatcctcaagacaatggcgtcttccaagtctccggccacggatttgtctcgtgcatggccacataagcatgtgtacgagtggacgacgctgtgtgattctctgaggaatgcttcgaaccaggagttggtggttgccatggagacgttttgcgagcaggagtttcgagccgtgctggccgtgcactatccccagtaccgtgttcagcgtcgtaagagttggattgatacagttttgatcaaagggtagtaaatctagtgggctggggatgggatgtatttaaatatttaagagcggctatttgaatccacgaacggattgattggctgcaaatatattgattatttatggagcgtgaaggtgaaaggtgtttatgtacaggagattgcagtatatatcgtcactacagtattagttacgataatcgtacatttacagatggtattttgtttaatatcaagtgacattgaattattcctaagtaaattcagtactgtagttgaaagacaccccaccacaatttgccaacacaactttttcgtttccgactcttcttcttccacatcactcaaacacaatgacacaaacgcagtgacacacaggccatggcacaaacgcaacgaacggagctctcaacacactcaccctcctcctcgctgtcacaaaccccacaaagccgaggacgcaatcatgttctgtctccaaatcagagtgggtttttgcgtgccagtaggaggagtatgagtgaggcaagaggttcttttgttataggtgtttgaggtgaccggcgctgtctcagaacaaacccattcgacaagaccatgagtactcaagctgccacaagtacaatctcaagctgtcacactctcaccaagcgagcagtttcatatgtgcacaacgttgtgaggcaacagtagtattttgatgaagaacgattacccaacttggatcattcaatacaataccgaattacaaacgagccgcaaatgccattacagtactccacacaaacacattggcatttgcacataacgctgatctaatcgatgtcatcatcttcttgctatgtgctaatctcaagctgaagtctttactcgctttggaacaggcccttcagaagtggccctattttcctctgtcactgtctctccttccttctcttcccgctcactgtcctcctcagtcactaggttgccatcttttccaagaggaaaaggctggtctttcttccaggtgaatcttttggcaggatgatcgtctcggagatgagactggccgggcgaggaataaatattctctctgagagtaccgcccggaacagcatagtcctcccagaatcgacctcgtttctgtagctcgggaaccagaagtttaacgatggactcataggtgcctggaatggtggcactggccagattgaagccatccacgtctccgatttccacccactcctccagtctatcagccacagtggtgggagagccgacaatgacctctcctcgtccaccaatgacatactcctttgccactcgcgacttgttccacattccgtcagtttcactacaagaagtagcccactgcgcaatgatctttgcaagtgtatcattgtctgtcacctctcgcagatctaggtcgtcagggtatttgctaatgtccagatcaaaccaccctccaaacagagtcaaggcaccctcgggatctacatacgagttgtattcgtcgtacttttcccgtgctaactcgtcggtctccgccacaattacaaacatcacggcaagggttttgaggctctgggggtctctcccgatctttgcggcctgttctctgagatcgtcgaccgacttacgaatgaactgtggggtaggaccagccacaaacgcagcctcagcatgcttgcatgcaaacccacgtccagctttcgacatgccagcctggaacagaaacggagttctctggggcgagggagaagtgattgcagggcccggtaccttgaaatacttgccctcatggttgatgtatcggacgagctccgggtcgaccagaacattggcctctacgtccttcttgagcgcatcttctcgccatgacgattcccacagtttgtaagtcacgtccagatactcgttggcaatgttataccgctcatcatgagcaatctgacagtccagaccgtggttgatggcaccagactcgagatacgacgtgacaatgttccaggcgactcggcccttggacagatgatcgacagtggcaaaacgacgggccaaaccatagggcacatcgtaggtggttgatacggtgattccaaagccaatgttattggtggccatcgatagagcagggacgagataaagcgggtcattgacgggaaactgggtaccagtcttgatcgctgtatccttttcggacttgtaaacgtcgtaaactcctgcagtgtcggccacaaatatggcgtggaatttgcctttttcgagcagctgggcgagctcgacccagtggtcaaggtcgttccagttcttctgccggttctcagggtgtctccagagtccagcgttaagatgattgggggtgttcatgacaaaggcattgagaatgatttttttcttttccggatgcttgaccggtgcagaaacggcgactttgccgttctcaactcctttttgagaaatgatgtccatgaatcagatgaagacttgtctattgtccagatcaccatctcaggctatcccagccacacttcagccacacttttttcaaaggctattatcacgtcatgactgaggggagtgaaaccagagatggatggcgcaatgtggctggtgttggcgaatcatgtgatcagaccttcctactgcactctagcatcacgtgtttgttccagccaaggctcttctgattaccgccgtacctctacgccgagattctagctattcaggaacaagatgttatgcttgggtgtggtgatggtaaaggtctggggaactgaagacttttgggtattccttggtgatttgaggttcatcattgacaacccattttcaacagacgtttgctgggctcggtagggggggcggtggatggagtaataagctgtgttggcaatatgagacaggcttgatgtcaaattttcaatccgtggttgatgaactcctgctttctttatcctgcttgggttgctacacacctctcacctaccctctgctgtgagagaggatgctggaacatgactgatgatgacactgggtgactttggtggatcatagattgataaagtggatgtgaagtatggatttgattcaatctgttgatggaacttggttgaatgtatcaagccagggcttcttttatctttccctgatggggtagtttcagatagccgtttccataggtggttttgtggattcagactctgtaacttaccactgacttctcaatatttctattatccaataacattgtcaatcctgccattgaacaaactaaaagggacctgtgcgattattgaggagatatcagtattcaatattactccatatatctttacaagtatcgtagtcaatgtcgtcatattaaaaaaaggtctcaaaaaatcttagggctcgccagtctcagcgagacgaacgccaatactctgcgactggtatcagaattaagtccctatttttttgacagttcatggagggtatttccgagagaatgttgaagagtgtatgtttcaggcgttgctactaacagacagagagggaagaaaggggaggaggagacaatatggatgctgtatggactaaaatgaagccattggaacgtagtgaaagaagtaaagagttgaaaatagtaatcaatgtcgagattgtaatagcttgccgcttcttctgtccaaatctgaccactactcattgaattggagtttgtctcgtttgtgggtcatggtgttaacgtcagttttgtcagtgattagctaatccccctgaaatagcgatactataagtacacatggttggaagagcatgttccttttcgcggtttggccaagtcacaagtggtcacaatcgaacaaaaatggctctccttcagcattcaaaatctttcaactacacacacttgactttactttgaaattttaatgaggtaccactttcatccctctatactcctaactatatccaaacttggttaatgctcccaacaaagtacatcatcacttctaccatcacttctaccatcacttctaccatcacatcccaccactacaacccactcataaccccaccatctccacctccgcatcgacccacgtggtgtctcacattacactcaatcacgtgacccctccagccctcctaatgcacattggcgaaattacatgaggtttcacatttggctcggggtataagaacaaggtgaaacagcgtgcaagggttcgtctttatggatgggtgtggagatggaggaggtgaatggaattgactggaggaggcgcatggaattgactggcggacggtgttgaacagtgttgaacggtgttgaacggtgttgaacggagtttgtctgggtgaaggagctgacgaagttgtctgactggcagaactgtcagggggagttgaaccactgtgcgaacttttcatcagttgcaactaccgaatctctcacgtttggctgataactgtctgagttgtctgaatcgtctgagtagattgacaagtacagtagtgcagatacaagcagtgtagggacgaggagtgtacggtacgtctgtagatcgaggatataaagccttggaacaagaaaaaagatattttgtcctctccgtcttctcttttgtcctctcttggctggtgtttatgtttttttccattgtctcattcaatcgttctgtctcgccctacttccgttgtcccgccccatgactgcgttatccatgcaagataacagccaatcggagtttggcggagaaatgcgggaattatggctgaaaacgggcagttttcccacccaactgagactgggaataaccggaccggtcggacttgctccaaaactaccgcttcgcaacacccgttatcctcgtatctcgtcgacgataacaaccctgtcagtggagagaaactcgtcaaagttgccgataggcaatcaaactgtaaccctgaggtggtggagcgggagacgatcattgagagtggagtgagtgaagagcaatgttcgaacttggtacctgttcatgcttgggtatgtactgttcgtgcttgggtactgttcgtgcttgggtactgttcgtgcttgggtacctgctcgtgcttgggtacctgctcgagcttgggtaccttctcgagcttgggcctgtaatgaaatcttgtcagacagtgcaattgatgaatccctacccacatactcactgcccagactcaccgcggctcatagatacgccagaccaactctcatctgactttgacagctgggcgcagacaagacaccaacgaacaataaaagccagtgagaattaagccagtcgagtctgacagccatagttcgagtcagtctcagtctatgactgtctcacaagcttgataattattccacctttgtggtatctgctatctcgccaggtccttccatcttgcgctgtctcacatggcaactgtagggagccgtcggtgcgtgaccgtaatatcggccgcaaccaaaccctttcccctacatacttgtattgtctgggacgagggtccgggacatattatcgggtgacataatgtggacagaggtggggtgattgcggagttgagggcagagagtaggcgcgatgttgccgcgcggttactgtgctgtggggaggtggttgatattgaagaaaatttcagccgctagagccgctgtggtgattctgttgagataagaacgagcctcctagcccagatttatgacccgaatgtcagattacgacccgaacctctcacactcgaattattggccacttctggatgtttagccatggtgctgggggaattacatctctagaatcagattctcgagtcggctgatctttttgttgtcagaatccagatcctcagaccagaccttcatctcgtcttttctgactcgaacccgtctcgcaaacccgtaccaactactcagtagtaacacttattaggagtctctacctttgccgcaacccccatcaataaagcccctgaataatccccggtccctagctggtacgttgtttctcgtagcaccagttcgccaacatggggaagatcctcactgactagcgttcaaggcaccaatgtccgcactaatagcggcatcaagaagcagccctaccggtagttcagtacatggtacaacatccagtacaatacagcaccgtagtccagtagtacaagcagtaccccagcagtccagttcctccaatacagtcgtgctcctaccgctagttcgattccaccacatccccccgtatcccgtatcccgtatcccgcaccatgacccacggctgaccaatgtcggccatctccgagatatgccttggccgatctgagacgagtcattccgagagccaatctcagattgcattcggagccagcgtagccccatccagggatacccggcgacgttccaccagtctcatgcccccggtcccaacaaagcttcacagggtctgagaagctcctccagccagggtctctagttgcatagctgcaggttccgattccggccacatgtctgtctcttgtctccccgttgcatccacgacatctgtcgatatgtacgtctcgcactagcacgcggctctcgagctaatgttgatccggggtatgatcggcaggatggaggtggagagcgggatggtggctggctttggatggagaatggagattgtataggtaatcagggaaccacagtagccgtagccaatggaggaggtgggacgagatgaccgccacaccgccaatggagagaggtttggacagccccacgcttccctgcgttgagcaggtgcaaatccggctcaagctctgacactggcgtgaaacctgctcgtgtggagcatgcgcagatagccgatctgtgacgttggcgccgatccggagcgacatgaaacagggtgctgacaggggtttgggaagtgtaaagaggtggatgggagtgtaaggagtgaccaacacagggtatagccttcgtgatatggacagcaagtggttgtcggaatcagcaagaccggctcttgccaggtcgctcttccgctgtaaatcaccgcttctcaaacgcttgcgaacactgagtttgtgcaacggactccgaaggtggccggatgaggaagcagggcggagacaattggcagttaagaagatgtggcagtggatgtggccgttgagaaggttgtggcagtagaagtcatgtcacaggtagctggttgaaactagtctggggacagattggtgacgggaacttggactgatctttggtggagtgaccttcaaatgaatcttaacgtcatcatttcgaggtgccaagttgccgtgatttggtgaggagtcggaatctggtggtgtagtcatctggtcaaacgatgctggtgaatgtgaaatactgtacagtatgtaatgtaatgattgtagataatcggttaaacattgttgagactgttgaatgctagtaattcgaccgactgaaccattcttagaagtctccgttctcagaatcaccgatttcagaacaggatagctaaggaccccgacaaactctcgtttcagctgaacctggtccaggccaatgacaatgtagttccattggctcttatggaaatagggcgtcgggcgtattctagtttctgttgtagttgagtgtaggctatggactagaccatagacagtagatatcagtgctctaacgccacaccatctcatcacccgtcgacatagacgggagagaacttgctacagtatcgtactttcggagttggtctgaccctatgtccctactccagtcgcagggggtgctcaggggttgtccacagaggttgctcaggggttgttcgcaccagtcgcagagatttatcaggagtttgcactcttggacttgaggagcagatagagcgttgacaaaaacccaactggagatgaagaatagcgaaaacaagacaaaaatgacagtggagataatgtgacgttagttggtgttggcttgacattatcgtaaagtgaattgagtgaagtgagtggatattagcagacttgctgactaggatgaagggtggtagatcgaaggcagtagattgaaggcggaagattgaaggcggtagattgtaggtgaaagccactgacagcggcaatgaccgccgctgacttcaattcaaggattccaagcatcgcaccgacccaaatagtgcctagctcgacctttgtccatcttgtgttttgttttgggatgggtagattgccaaatggacgttccgggtcttcaattccggtttcgggttcgttccagtagactttcaatccagctattttctactggactctattcgattctacttgagtcggtgttgatcactctcagtttcgtgtgttgtcactctgctactgcaacttgacaactccagagagcttgggtggtttctttggtgtagttgatgacgacgacctcatccactcatccactcctccatcttctcactctctccctcattgcaagacggggccttgaagcggtacccaggctgatgtctgaacaggaaacgccatcaacagagcttctcaaatctgggttggaatggtgattttggcagctggagagaggtggactagggaatctcgagtggagaaaaagacagacttttgtatcgcgattcatctccagttcaagtccagattctaatcgctcttttcgtcggtgacactcaaacaatgccggtacatctgcgccgctttcgggttgctttctgctcaataaatctcccttccacacagcctctgatcgacgatgatggaggagttgatcaagatgagcttcgaagcactgcaccaggagcaccaggacaactgggcaagcacataatcggaccaccaggagtactgtgcgagcaccatcagggccaccatcttgctctactaatctacggaccaatggagaactaccggtctaacggacccaccccaggctcgagaaaccacatccacacgtgactcctgtctctcacatgtggttgttcacgtgtgtgcttgaatagtgtgtctttggcaacaatgtgtctcttttggctgcctctgcttctatacgtggtcattgccggaaagaagaacgacgagaagccaacgatgcagccacagatcagcgatagaggcggctaatctcgggatgataaccgcacagtcccatccttatcagcactggcgttatcagggctggggactacgatggttttggttatcaagtagtttgggtggatgtcaagtgtctgatcgtcaagtgcttgttgccattgtgatatgactcaaatcattcggataatgaccacctcaactccaagaacggctcctccgcccttcacgtgatctggcccaccgccatctccaccaccagcccactcatctcaatatcaacaatattatcgacacttattatttgccagggtcaatgttgcagatattattggcacctcaaaaagggttcacaagagtccggaaagttacgtcgacgagattgtgggcggttggctgtggcgattgtggccgtggcgagtgtggctggtccacagacggtatccgccaatatagtaatagttgggagttagttgagcgttagttgcgtgtgttggaaagcctgagaaggtagtttgactgtgggaattggtagttgggagttagttgggatggcttacttctcatttctgcaaacaccactccactcggatttcgcactgacatgaccaaattgcgtggtgtggtgttgccaacctccgggtggtttctgttctgggatgtttctgttcggagttgtttcttttcggaggtgtttctgttcggaggtgtttctgttcggaggtgtttctgttcggaggtgtttttttctgaagcgtttctgttctcaggtggtttcggactcgacaagatggtcagtgttattaagtcagttggagtctcggtcggaaactagctggggcccaagtaaggagaatagccagtagacaacacggaaacaatggatattccatctagcttcaaagttgtatcatcttgtggcattgttccatcaacattctatcgacattctctggttctatcgacactgcatagaccttctaggcaccgggctgcgcttgttcttcgagcaggtctctctcgatcaatctcacgacgctcaactcacgtctctcaacctccaatttgtctggccattcgggctagtccgcattcggaggaagacagctgtactcggcatccaactcgagaacggtatgatggttcgagtaataatggtgccagtaaaatgatctaaaatcgaacctcgtctttcttccgaaccaactggtgatctgaacatactccgaggaggttcgacgctgcccagaacagcccatatccatcgagtttgtcgagcgacagtcaacttgtaggaccgttgccacgattggccctggtcccgccggtctcgctgctgccgaccagatcaacagggccggccactgtgactgtacggtgagcagaccgacagggggtcccctaggatgccaccaaaggattcaactgacggaaaaacaaccacgcacttctatagagcgattgggctcttgtttggaagaggaagagatggctgatggttactgcacaccattatattgtgaaaaacacttggtctcctctgatcgtcacagaaccagttccattccagtcaactcggcggaaccagtgttgaatggcctaccttgtgaatccattctagccgtttggaaacggggtagtgaaggcacagtatggatctattgagattgaacctgctgcgcaaagcgacaattgcgagaacaattgcgaaaagtaattattgcgaaaagtcacaaaagtatagttgctcaaccagacttcttgaccccgggactagactgggtccacttcaacgctcaaaagtgcaatcagctgctatttggtggaatggaattgatggagacagcggtgaaggcgatggtcaaatgctgagatgagtcctccaagcaagttagtaagtgtttgtcgcgaaaacagttgtcagccctcattacccccaggtgagatgcggtccagacaccgcgtccagacaccgcgtcaagacaccacgtgcaagaatgataaacatgtcggcaaaggtcggaaggtggtcagaagacggagaggtatttcctgacaacagccgctagctcatcagacacatcaatggactgtacgtagataggactcaggttgacggtggctcatcagatcagaggaaagaccagcctgaccgggattgctgaagttgaagttgaagcagtcctagagcagtcctggagcagtcctggagaagtccagacgaattttcactccagaaccggagacgctcatgattggatatacggagacaaaaaattggttctacttgtaaggaaatccatttcacccttttttaatttttttttattattattattctattactactattctcaattattttttttttcaaatacaatttcaccttttttaaaactttttcagttgtttttaaaaaaaattaattctaaggaaaatcaaccacaaatttcaccctatcctgacccacccaaaaatcacgtgatctcctcgaattcccgtgacccattccatcgcacaacttaccatctccgcttctccagtgcggggtatcacgtttagtgctctcaatattggagtgggggtgtgcgtacagctgtattttggctgacgcgcgtgagagaaaaagcgcgtctactttgacgagttttggtgctacagaaacaaaagtagaagcattggaatcgtcacgtgatggggagtttacgggcaccaatatcaccttcatacgagaaccccaagacctcaatatccctcccactctctattcaaattaaaccttgaccagatgcaccgcattgcgtccctgcatgagcatcagctgagcgaaatcgttatgtggcaaacgacatttttttgtcgacacattttcgccgtattcacaacacatcagaacggtcaattgggccggatcacgtgccacacgggtcctgagaggtgtatgagggtcatgtgacttgttttatcgtcatccctatctgtgtgattgaatattatatttaacattgtattgaacgagtatatttactcccgttgaaatgtctttattcctgtcgggtgtaatttccatattaccggtagtttacgataatactgtatccccatggggttttagatccatgtttgaagtccgtcagcacccttttttttttgtctgatttttgtctaatttttgttctgttttgtctaatttttgttctgttttgtctaatttttgttctgtttcgtctgatttttgtctgatttttgctgtcttttgcctgattttgctcttttttcttttctccaattcgaaaataaatctctaaaccatgagccaatcagcaaccaccaaaagccccgaaagctggcaattttccgccgccgcagatctgtgacaccagcatccagacgtgcacgagtcatgtttacgagagttgcgggaggcgtattgtgtgcatttccagagcagttggggaaatgagtaaaaacgaaaaaaaaaaaaaaaaaaaaaaaaaaaagaaaagaaaagaaaaagaggacaaaaaaacaacaatcacctttttaaagttccatacccaaaagaattagtatggaaaaaaatgaaaataactgcaaattgtgaacgatagagacatcgtgggaaaaaaagaactattctcgtcattgtctttctcctgatatttcaaatatataaacaaatggtcctatttttcatacactttacacctcaacccaatcgtattactggtacagtatgtacatcctgtaggtatgtacgatactccagacatgactcaaagtgactccaaatgaatccaaaagtcagacagaatgtctagaacttggccaaaatgtccgattgaagccgttggcgtgaatatctgtcaacttctatccctttagaatcgtatctctaaaataactctgttttttgagcagaatccagccgttctcatcattccacccccaaatcgaacacaaaactgccgttattcaacaagaaaagaacccttgaggtccccagtcactcagccacgttctcatattgcaactttttgatgcggatcgatatgttttttttcctttcttttttttctttctttttttttctttctttttttttctttctttctttttcttctattttttaaaaaaaaatttaaaaaacccctccttgaatccaaccgccacatcccataataacaaccgtgtgcaaaagttctagccgaaccaattcaactgtaggaccccagtgcagtcctatccagcgcctcccgatcccactatcacgtgacccgatgatcacgcgattttttttcttatgccttccccgcaataatttcccgaccgacccctttccgagaatattgggccgaaatgtgagaccaaaataatgtccgaaatattgtgtgaaatatttgcacgaaaatatcgacaaaaactatcaacaagaaaatcggccaaaatatccaaactgataacatccaaccttgcatgttgcacaaggtttgcaataaagaatgttttaaattcgtgacattattttcaacaagtcattgtgtgtagtggacgcgacacaatccattgtcggtaagaaatgctaaaaacatattgtgaaaacttgaaatcaaccgccttggagtatcgtcacccgctggttggcagagattcctcgtatctgcctcggtaccaggtcgggtccaacgcacctctaccccacaaaaattgggttatcggaggaccaccaactttgtcgaaacaaggaattagtgaaaacaatcgcagtagccaaggtcaacgtagaccatcgcatcgaccaccatcgcatcggccaccaccgcattgacaaccaccgcatcgaccagcaggctcactctttcccgactctggagctctttagagcccggaaccccaatctccatcctccaaccttctcgcatctcaaatctccaccgagccggcagtctggggtgcagctcgggagccatacagccaatatcaaccgtcgacgcataacctcgcaccaacagaatacgactcgcgcaggattgcagaatgggcatacgagcagccgtatatgcttgagcagtcgtacaatatcataccgcagctgcagccgtatggctctggggtgcacgatacgcgcccaaaaccaaaaacaaccctaaactgagactggtaccaagtcgatctgcaacatgaagtccgtccgccatgcatctgtgagcatgtgagcagagtgggggtccagccgaagacacgaggctcgaaatcgaaccatgtcgcgccaccacctaggtaaagggagtcagagcatgtgagcaaaagcgtgagagcatgtgaaagtagtgtagaggtgtcttggggctgacgtggcataatcacggactcttaacatgcgaattgactcgacaaagaggtcgtatgaatcgactcgtcgtcatgtggctcagtagaaaagaccaagtcgattgtttaacgtgaacatactaacgtatctgggcacaggcattgacggcatccacggtctggtgagtttcatttgaatagccaactgccatcacaacttcggtaacactacctgccatgtcacaactagagcaacaccgtgtcacagttgcccaaaacagccctgaaactgacacaagctagaccacaacgacacagacttcagtcctcactgaaccatgtcattgacggcctctaattggtggtcaaaacatttcttgtgattagcagtatagaaaacgacataccattcacccactcagtcttgtccactcaggcttgtccactcaggcgtgtacactcagactcacctattcagtccattttcttctgtgttattctctgacatgatccctgtaaccatacccaacacaccgaatgagacagactgcaaaaatcacccagaaacaactccccaggatctgcccatgaccgccactctcgtcgcctaaaacgtctcaatcacagtcaatctcggacatcaggagagctgttcttgtctagttccaatctctctgtgtttgtgttaccacctcccaaaccataccccatctccggtctccgccaatcccatctccatactccgccaatcccatctccatactccgccaatcccatctccatactcacgtctcctcaatccttgcgcaattcatctcttcaatagttcatccctctcttttttttcttcttcttttttcccattcttttcccattcttttcccattcttttcccattcttttcccattcttttcccattcttttcccattcttttcccattcttttcccattcttttcccctatttttccctttagtgacatgtaagaaatcaagaacaaaatccgctacatttacaactatatctgttgggagttggtaaagagggaaaacgcaccaactaacgacccgcagccaacgtgcatgtacaggtaacgtgcatgtgcagatcagatgcatgtgcatcgatcgtacatgtagcccgcctatccgctgcggatacggagattcaaaaatggccaatagcaaaaaaaaaaaaaacatgaataaaatgttgaaaatagttataaatttgagggtacagtggtttataactatttttgaccgccacaaaacaacaatctggataataataacgactaacatacctgtctttgatcataaagactacatacctgtctttgatcataaagactacacacctgttacactacaaccaactatcaagtaaagaatgtatatagatatataggcctagggcaataaattaaacggtcaggagaccacggtcagttgaccaatgtagattagtaagcgtccgggttagacattagtaatactccagataatccaacgtgcccgaaaacggactcagaggagtagacggatccaaagtaaaggcattgttggcaatcatgtgacagttgctcgcgagctcggcctcggtcacgtggtttggcaacaattgcgcaacactgacgaggtcgttgatgtcagtcacgtgaccgagctcgaacccgtcgtccagaaccggtgtcgtgtgtcctggcgtcacgtttccgagaatcgtggatgtgaggttggcggcggggtcggacaggtggttatggttggtcacgtggccactagggtttgtcacgtgagcgactgagtcagcagatcgatgatggtggtggttggccaccggcgtcggcgtcggcgtcggttcgatcatgtgggacggctcacagtggctggtcacgctcagctcaaagtcgcccacatgactggagatcatgtggttggaggtgtcgacggcgacagtccccattacgtcagcagatccgattatgtcagaagacccaatgacgtccgcgagccgtcgtcgtgacacgtgaccgttcacatggttgctgcgcagggcaaacacccgcgaaagctgctgttgcaacaccgttgcgggaccgttgcacacgtgagtagtcacgttactcgcttgtttgccctcggaaaagtcgtgacagccgacccatcttcctggagcctttggggtctggatcgaaaagctgggtgagcaattgagcgtcagattaagagctccgagagtatcgttggggtttctgctcacgtggatttcctcaatcgccgaaaagggaaactgcatgcgaaactgcgtcttctccgaggtcatgtgatacagcatggtgtctgtgctggggtagtaagcaagagaaagttggggcgaaagtcggcgccaatttccaatagtcagcgaaagggtggggaagaagatgggcgggagggtcacgtgatgcggtgtggtgggggtcaggttaggagtcatgtgtccgagggtggagaagtcggtgatggacgaggcgggtgagtcaaccgtggtcacgtgcgacgacgaggaagaggttggtggggttgcgagcaagtggttgaaatgagtttggatgggggttgtgacgaggtcggcgccaaagtggtggagcatgtctgcggaactgctaacgtcggtgcgatggtggattacgtcaacaggactgttgattacgtcagccgtcatgcttacgtcatccacgctgacgtcatccacgctgacatcagcaagaccgtcgtcaaagtcgtcctcgcgagattcccgaccgcgcatagccttcttctgcttggcacgcgtgttctggaaccaaatctgaacgctacgctcagtcatatcgataagagcacttattcgacgtcgtgtggcagcgtcgggagtggcacacagacgatactcgtggcggagcacgtccaattgctgtgcgttagctctctggcgcttgttgttgcgttgttgctgtgtcagcgtcgacttctttgatcgtttcttgtccattgtggcgctggagggggtggtggtggtggtgacagaggtggagtggtgggcacgacagaggcggcgtggtgggcactacaggggcggtgtggtgggggagatacgggcaatgtggtggcaaatctgggcgaatgtgatgggctgacagagtcaatgttgtgggtacaaggtcgtacttgtagtcagtcggtaccagcgtccaggtaaagggagttgatatatagactaggattagagtttagactttgtgttttgcgacccacgataatatttgccttgtgcatcccgtgcagctgcagcatgtggcaggaggagaacctctggcggaagtgctgactaatacagtaatacagggtctgacttagttatggggctggcaccgtcgtggtgatgactcagctcttttctgattcgcaatggggtaattttcgcgtgagtagtcagcaatattaatttttgctcttcaactttatttttggttggggattttcgaatgggcgtagcttgatgaatattggtcatagagacaaggtggaagtgcaagcgtgctctacgtcgtattctgtatctttcacggctctctgtatctcgctgacatttctgaatatttttccaagttcatttctaagtccaaagtccgcattacatccctaattctgccaataatagcgccacagagtcagaaacacgctcattagatagcctcgagtttggttatctcgttgctttagttagccagttaaaataccctctatgaccccctcgaaactgcccccaaagtattcgcccccttacaccagccaacccacatgacaggtgcatgcacacaccacacgggcacagacggatgtgacgatatagggtcaatcttaatttagggtttgtgcacacatgcaagatggaaataggaaacgaaaagcgaaaagtggataaacgcaaaacgaaaaaagccaaagccaaagccaaacgcaaaacgaaaaacacaaagacctaccaaacggctcgatattatttggccacataatattctgactacgctttcattgtctggtcagcttgctgtttaactcggtcacgtgtctgacgtcactatcagcagggtgcatcagaatggacggtgcaagcgagcgcaattaataacaattaaaaaaacgccaataaaaaacccggatattcggataaaatggataattttttgagacacaaatcgacgaccccggcgtttcggcggcacgtgggaaagtcgcagttggtgcttggtaagcagaccaatggaacagtgcgaatatagtcggagcgttagtacttgcccccacgatcgctaatactgacgccccctttatgatgatgactaagactcaggggcgcggctgacacattcccccacccctcccccccccccccccccccgaaaaaaaaaaaaagggggtccttttgccctttgcccctgtttttttgcccccttttccggccccggccccgcccccccccaatttaaccaaacccgggggggtttttttttttaaggttaaaagcaaaaaaaaacccccccttttggttccaaaaaggaaatttttttttcaaattttaaaacccccaaaaaaaaaaggcgaaacccctttgaaagggaaatttgggccccgccgggggcttcaccaaatttttttaaaaaattttttttccccgctgtaggggcaaatggaaggggttgtttttttcccggggggggaaaagggggcccccggggcccccttttttttttttaatttgggccccccccccccccccttgggttgggccccccccccctgggttgggggggggccccctgggttttttggggggaaccccctccccctttgtggggggcccctgccccattttggggccgcccccaactttggggagggcccccggggcaaaggggggggggggggataaaatgaatatttccttaatacacagatttacgacccgggggggcccccgggttgggcgaagggcgggggggggggtgggtaagcaaactaggggggggggccgggggcggggggggggttattatttccgggggttttgggtttttctgccgggtttttgattatgggggataaaaattagggttttggggcccggtttgccccgtttcttcccccccccccccggtcccccccgggcgggccgggtttggggtttttgggggggggggggggcgcgggggcgggccctgggggccggttcctttgtttatataaacaagaaagggtgtttttttttttcttaaaaagagaaaaccaaaaaaaaaaaaacccccaaattcgcccccaaaaaaaaaatttattttttcccaaaataaaaacccccccgcgacacaaagagtggaacattttttgtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaaatacttgtgacgagtattctgtaggtggcggtcgaaaggcgacaggtagacttttacgaggttagggtgatcctactggtatagcatgtcctaaaagcagagcgacagaagaaaatacacatccttaattgtgtcaggaggggcgaatgagcgctgagatttattggtgtctgagaattgtaggtgtgcatataaaccgtgtaaagattatcattaggatgtccgatactccgtcttccgctttctgaacacgataaaaataaacgatagttagttaggttttgttccgaatagggggagttagattgcacaattccgtatatcgaagatggtgtttatgaagcgaaatacaggaaaatacattgaagatgaggcggtgtggtttcaagactccgttcggtataaaccaaaatacatggtgcggtaataattcaattaaaataataactgcaaatattagcagttgcaactaagaggttgactgtatgtggtttaaatgggtgatatgagaagtcacctatttttacttaatagcactagtcagaaagaaacaccttagttttcaggttagaaggtgtcagccaagctgaagtgtgagaaggtgaatttaccttaggggttcatgagtaatgcgtaaggatgtacctcatctaagagtacgattcacgttttcagatctatcaggagttactcagaaaaatgtcatcaagtctgcgaaatacattttcataatttgtatattttagttcacatctatctgagcttaaggtgtcgtaatatttctcaactaatccataaagatgtgcattatcctcaggtaccacagtccttcagtatgtaagatagatctttccaaaacttgcatggtcatgtactcattccatccacccctaacactgcacatgtgaacatgcatccttcggcgtgccaaccagttgctaggttcatgtattcatccttaattatggccggggcaatattccagtcggaaatcgtttccccccccccctacccgagagaacctctctgtctttgtgggcgaggtggaattctgttcacttaatatgcatcttttgatgtcaatcacgtttatttcgcactcttttgccgagaaaaaaagaaatagttcatacacggccctcaccgtcagtaacaaaccttcaaaattttaaaacatatgttccgtcccccccgcggtagccagtaatgtgctcacttgcaccttgctccatgcttcttgctcccagttcctgctcctgctcctgctcctccccatattaccacaacccgtgctggctttgcgtttacaggttagatgcatcacgaatcagcccatactggttccaacatgacgatgtaatttccagattatcaacaaccgagcagacaaagctgaaacccatgtgaatggcaagtctggccacggcccggggctcgaccagatattttatgatactagctgctccacagctcatggccaatcgtagaggctgtcgttatcagcatggcggcaaatgggggcacatggggacacattgctgtctatgacattggcctcgcgtcgtcaccacatggatcgcgtcgtcaccacatggatcgtgtaggggacacatggactatgtgatgggaaccactgctcccatgtagtgggcacatgagccatgtgatgggcaccaccgcgcccatgtagtcagcaccacaactacggtgtaggggaaaataccgcaaaggtctaggccgatgcttgaagtcggatggcggacttactgcacatggcccccacgaactgtgcagtatcacggctttatcgcggaagacactgtatggcctgtagtatgcactgcacctccaaggtcagatcggcacaaagacaaccagtgtgagagacattgagtgtacttgaaagtcgtaacacctggttcatcgttattgaccattgaccaccatctgacctatcccggtacagcacttgtacttggttaccctccacgcacagcggacttccgacactcataatatgacaatggcgacgggtattaataatgcggtggtatccagagtcaatttagtcacttcaataatgcaaatggagtacaagtacttgtacgagtagattgtacttgtacttgtacttgtacttgtacaacgtctggcacatcaccacaactacgcagaatggcgataccgcctcaactgcaattctgaatcatactcgctcctccagactcccaaatagcccagtatactcaccgacgcattcgttccactccttgagaacaagccctctgtcactcaacgcagccccatagtgtcaccacacccaactagtgtcactctccctagtcactgaaccgcatcgactgccgcggaggttatccgatacgctgtagacagatgcttcgcgatcgctgcccaattgatacgcattgacaccacccgcgcaccccgatattatgccacctggatagtgacacaaacagcacacaagacggaaaggaaagagaacggcacaaacgacgaaaagaccacccagacgcaataaataataacatcgttcgattcttctcaatcgactgattccattgctgcgctttgatttcctctcagacctccctcgtctctctgtgtccactcttccgttcggccagctgacagcaccgtggcataatatcgcgggtcacgtgatgacagggaccgccgcatcctggacagactggtcggtctggtcgtctagcggcctgcgtagcaatcatgggtgtgtcagggccgttgtttttttgtgccttttgtttttgtgtgagtaaaaaagtaggtgacacaaaccgaagcagagagttaagttacacagacgcaggtgcagcgaaaaggtggggggtggtggtggggatgcggtaaggtaaggtaaatttgaggctttggtttgatttgattttatttgaattatttttaattcttctgaacgattttcgaacgattttcaactgtatctacccaaatttgtataatttatgagcgccaaaaaaaaaccacatttaccgtccatccgtcaaatttttgtctccattttttgatcaattttctacacaattcctgggctggcgtgtgatggtggaaaattcaaaagatggattttttaacatttcggtgcaggcatagtttaaataaggtttaggatgtcggacctctcggagtttggagttgggtgtcagacgacactactagcgggatactggggtgtttgaggaagggaaaaaggagaaatattggttcttaacacgtctaatactgttgggtagcaatttaaagcttatctgagcaacaaaaaccgagctggaggttccctagtgtggatttagtacgatactggaattacgactcgcttaaaaaaattaaccgagcttattttgaaccagtacagattgtgggagtgtcggtgaaggttggtgaatattgcctgaattggaattttcaaaagaggaatatggttgtaatgtgatttagaatgagatgattttgtctgattctgtctagggtttctccagccagagatgtagggtatgctgtatcttacagtagagaccatgacatgtgtcagagtagaactgatgaaggagggtgaaagtgccgtcattttgacgaaatggggtaattctgtcaaattttcaaacgaaattgaactatgatttactcttcttctttcattttttttttttacaccgttttccaatttttccaatttttcaatttttttccttttcccatgtattttcaacccctcggccactacattcgcccaaccacaaaagctgcattactacaagtagcacctcaaacacctactcggcagtctaaacccattgtcaactttccactaacctctctactgcccattactgcaccctggaacttattgtccagaacagactagcccagaaagagcccagaggttctccgtggtataataatccaatgagccgtccgtaggaagtgaatctggacatttcatcatcaatctctcatgctggctgcttttcagacccacttggtgtcatttattctacacagtgagtagaaaaaaatacatgaaaatatccatagaaatttcttaatatgatctagaaaggtgctggagaatgggattgttggggataatattggttagatcggggcgaatttggccatttttccagctccagagatcaattgagtgcctctggattctccagatttacttttgaattttatgtcggatttttccagctcatctgctcactattaaaaataatccttgatatttaatcccaagatctgctaactgccccaaatcgccttctagaaacacaaatccactataaggagctcagactaactccaataggtggtcttagaccctcttagacccgcccctgttggttgaaaactccacccataccagtagcagggcatgcccagtctaaaactattgtgtggaggtgtcgaaacgtgtcaaagtcgcgaaaaatacacgctactccagtattatgtaacacagcctgaaataagacagtttccatggaccaaaaatagtccacatctgtattagaccgtttcagatgctagtgcataccaaaactttgggattttctactgggcttaataggagccatattgagatttggactttgattatgtgctcttcaaactgtggggattcatatccatccttttactggatcgattttctgtctggtttccatcaatctgaaccatgtcgtatttctgcctagacatatcgtcggttattgtcattaaaacgtcaagaagttgtaaaaccggcattcttggcacaggtgtttgatccacgtcgccgtggagctataataatttcgcgagaggcgcgctcaaattgccggcttcatgcccagtagttttgaatattggaatatcaaaagtatttgatattaattcttggagttgagtgggatggtgagaccatgataagatgatgatatagattgttttttttacccaaaattgttttctttagttgattttactcattgactttgacctgtttccagtgccatcccttactgcaacttcacccatacctaactcactcaatagtaactctacaacctcacagactctgccattgtatccgtctcgttctaataagttggctggcatatatatgttttttcggaactacctctgacaaaaacttaccatcaactcagtcatagaccatgctgacacctgtcaaacactattgaccttgtgtgcgtgatagcagcaggccaattggcaagatacaaagcatttggagtgtcacagactgcagtctaacgtctctaggccctgatttgcacctctaactcgccaggaaccaatagcagaaaggagcgagtcactttttgacagcaatagaaagcaggggccaataacagacaggggcgggtcacttttgaggtttggaaaggctctgtcgctggacttttgacttggtgaacagctggattgggtttaggggaataaaacggcatttttatttaggacacattaaaccggattaacggggaaaaatggagaaaaaactcaacggtggaaattagaataaattggcaaagggaaagttccccatggtataaccgatgtctaatccacttgttaaaaaattgccgagagtctttcactgccccagatactcctagtggcgaatgtgatgacggattcttagtcaaatgtctaaagtacaaaaagttgctcttttgggaataatgacattgttgtagaggttccagagctttctaaagtctttataccagcgattctcaccatttttagtgctctcttccgtttggggaataatattcgaacacatagtggtattatcgggtagagtccctgcttgattcgggtgcagggtaaaacatattattattgaagtcaggattttgttagtaaaattgccgtaagcgtagttatcagggaagttcattggtataacacgtttcattctaccgtcgttattgtgcaagttagatgaatctatatcagctgttattggattagtaagcatcgcccttggggtggatactgttgagtctacaatgaatcaaagactcgtttaaacttgctgagacccttttaatatgcacaccaagcacgtatgactagtttttgtagcagatattacgccagactgatattacgtcaagggtgtgcctacccgctgtgggtggcacattcttggggataactgggggatagtatgaccaaaagttgattagagcaactggggtataattggtggtggttttgtgctttttttcaacttttcggggttttatacagattcgggtagctgtttgaattactgagataatcggtggaatcggaattgtcggggaaaggttagaaccggggtcggtaccatatcagaaatttctagcatgtcattcagagttatttgaactcagctgtaacataagtccaagtctccctcttcagtcggtcattctaccacgttgtccattctggtcgaaacactatgttcgtttcccagttgggaatcgatctgaatctgatctaaggacactgtttagttcgaaatatcatcctaagtgctattatcaatccttgatcttgtatttttgccccttccaagccattaatatattaccatcaatcacctttaagtgactccttggaccattgatcctgctcgttaaactgtccaaaaaagacaatagaaagacaatcaagaagccggggataatatccactaattccagttgtcgtaacaagcagctggctggtctagtctcagatacaatggcaaccctgtgtctagacttgtctagacttgtctcgacttgtctcggcttagactctgcatttgttgacccttgttggacggaatggatcgattggtagttacatctagagataaggtggtgattggcgaagggtttttcaaagattaatgaaggtcttggaatcctataaccgcgaatcccgcgcttatcggatccttggtgtgcgatccagctcttcacggatccttggtgcagtggataccgatttgttggtacagtactggggggggaggggggaagtcatttttgagacttcatttgtaagagatacattggtttcaagagatttagagtagtattctttttattgggcggaattttgaccactattcgtggttgtagagcaaacggtttgaatgattctgcagaaagacatgtgcaccaattttgaaaagctttccgtaatcttattgcagagtaaataactgttgtgattgtgttatcggtatcaaatcattcccggtgaattatcaatgcactacatccaaaaacataaccattggactccgcgttgtcagtttatttactctccgagtttcaacccggatgaagtacatttgcattcaaaatgaaatttttatttgccactttccactagtgtaaacgaagttgaaaagatggtcaatctttttcgatcctcttcaatcatgttgatttctattctatattgcatccgaactgctaccaactaaaatacaatatccaggtccataaacatcctcccttaggtctgtagtgttattcccatcacctgaccaccgttactatccactcctattcatgtgactttcactaccattgaagttcagaagactacctctcgcttatcgtattcgcttcgcgcggtccgtaaccctaattagcggatacggcgtcggaaaactgacgtttcggccagcaaaaaaagatatttctggcggtttctggtattggcatattttgggccgtaacattatttgtcttccccatcgccgattacagggatgaagcaactgacagtatatttctattttatttctttgatttttccttatactcttatttcactgtcaaaaatgtcaaaaatgtcttttcaaatccccagggcatgaccgcagatactcctccgaacttgactgttgaatcaggagtggacacatgagaaccattatcataatgagaacagtaattgatcgaacagctccgactactatactttagtcattgtcattatgaccaaagagaccgacgctgctagcagatccgcaccgaacggtcatctggtaccgcaccaatcaaccttccagttaatcagacttgactcgtaaatcgtaccggcataacctggtacccgtgtcgtatcacatgatgtcatgtcattgcttaccgtgttgaatcgtgccatatcgtaccataccaatcgcaccgaattgctgaaacattgatgctgtgtaaccctggcgacatgtgggctcttgttctcaagttagtgccaaacccaaggccagggctagtgtcagctgaaacaggcaccaaacgtgacgtttatcgtgacagcacgtggttagtcgtaccacgggttccacagctgtgatcaagtacagtacttgtactcaggcacgtagaaatgtgtctatcagacaattaccctcagaaaatcactctcagacaacacgctcagaaaatcgcgctcagacaatcaaacatcagtcaaacagtatcatctggtaaattcacctaagatgagctcccaaaatcaacccaccagccccgtatctttccgtcacgtgacctgaactgcacctgacaaaaacccggcgcattcattgcacgttagatgctagattatgcactccacaaggagactgaggtcaagctccactcaagaccattgggacgcggctagtggtagctcgaatcaaacaaggggggtatcacgagtggttgtaacgttgtcatcgtcactggtagtacaaagacaagtctttgaatcgctagtggttacctttaacgaatggcatcctagaccgacatcgcccttaacagatgataccatgtcatcagcaccgggagacactccaccacagatggtgacaaagtaacatacacaaatggacgtcgcggctgatgcaaatttcattgtgaacaggtcaaattcatcattcagatggtctagatcaaactgttgattcgttcaccaaccagacccgttgtccttccacgtgaccaattatcttcccacgtgaccaattataccccacgtgaccaactatcttcccacgtgaccaattgtccttccacgggactccgaaactccccggaatacaacgttactccgcactagccaactaccccttgatagatggtatacgggctggcgctgggttgggctggatcttttagattaaattaaggttggaaaccttgcgcttaatttcagatgaaaccacaaaactggtgctgacgtaataatatgtggggaaaatggggaaataaatgagataatcagattcagcggagtttttgcttcaatttgatatctgaaatatcccgtttttgtgttttgctggtcactccaaaaactggagatcaaatatcgtcttccgcatgcggacatgtgagggctgaaagacacgcgagggctggaagtcacgtgagggctggaagtcacgtgagggctggaagtcacgtgagggctggaagtcacgtgagggctggaaaaactcgtatcaaaactcgtgatcagggtagtttgcgggtacgacgtcatgggacggcagtttggggttgacaagttcagggagttcagggagttgagatcagggagctatatggatgatttttgatgttcgttttcggtagagatcggtatttggtggactgttccagtttattgatcatgaggatctctagttggtgaatctcgagtaagatgacaaggtaggtcggtttttatcatggaggaggattattgcgacttttggtcatttcgactcatatatctgttgtatatctacacacatccaatgactagttgtggagtcgtggagaagactgaattggaattccaaagctctagataagcagcctccaagacatttaaatctacaaacgtgactaaacagattcaaagtactggatgacaaatgcattgtcttactggagaaatgagtgagcgtcgtttcagagtcgttggagcctttcctaatggtgagtagacagacaagggaggtcagggatagtcaggctggtcaatgttagatactgccagttgcagtaaccctgactagccctttctggggaacgattcttcagggtctcaatggttgtagacgtgtaacaatgtgctaccagatctactgtgggttcatctatcagatgttgtgaacctgaagtaaagccaacctccttcagggcagaaaacctggctgagacctctttgcttcattttcaacacacacgaatagttttagttgaggtcagcattgacaattattgctccatcaactgaaaatatctttctcttgagatgctttcaagtgctgccaaaaaaccgctgacccagttccttttggaaccagaaagtccatctggtagggaagaacaataccctggttcagacctcgagtcacatgttcatccgcttctcaaacaaaccagggaggcagtcgtttcgattgctgaacttcttttgagccagctcctcctcgtggccatctgctgaataaaatctcctttgaccaattcagcaaagacaataagaggttcgaggcctccgtttttccatttccttagaggtactagttggaatcaaaaatcagacaacccagaagctcatcaccccgtaccaacagaatggtactttcgcacagacttatagcagaaaagacctagagacaagggcccaaaccccacaaatggcggattcagaggacaaatggtgacctctggttataaatacctacccactctccaatttgatgcactgtaaatagtattaaccgccaaaaagagtcgtattctgttcaataagcatcttgaggagattcaaatatctaccacatcggtagactatgatatcacagtagaaaggagaaggaagtgtagcattgaaaaaagaggagagtcagacaaatttccggccagccagaaaaatgaccggctcaatcggaacacttgtggcggtttttttcggtaaataaccaatcttgatgttcaattgtatagtatgtatgtactatacgtcaattatcagtcgaaaagtcgccatgaaacatatctaaatgtagtcgagttcagaatgatggacatatcgtagtttccacctgatccaacatcatttttccggcaactgacttcagccaaaattatcaaagatcatatcatatgatcaacctacaactgtagaatgatactatctataaaagcggcaactgtactagtggttcagatagttctaggggtttagaatgttgtacaactcggtcatacagaaccatttagtcatctgtccagaatccagtccacgaattacactgtctctatcaccacgagctacgtctatcgtctcttcacaaatgacattcatgaactccttattagctggaaaagggattaatggtccgtaaatgtagactgctttgctcagtatctggaataatcgtgacaccataccaatctctaacttcccagaccgtcagaaccctttcaatgcttccatctaacccattttttcttcagcaggtctctgaaagattcatggtggatatcgaagatcgagatcttgaaacggtagcactggcatacacgattcatacgagtaactacaagtaataaaagctcaataaaatcaaataatacctttcaagaccgttatataccactcgctcaccaatcaagtttagaacttcaatcaatgacaaccaaacaaacgaggttgatttggcgcgtaagagatggagacaagaagcgtttataaattgtaagagttgcaagtagttggttgattgacttgggtagctttttactgtcacaacagagagttttatacaattaatatccctgttgacagagtctaacaaaagtgctttgagacactctctctatctcaacgtggaagaggtttgtcaatattcccaagagtatattgttctcgtagtcatctatttaacacaattgtgttcatctagctccaaaaaagtctctgaaaccgacgaaatgtctgcttatatttttgcttgagtattacttgaaaacatattctcccaacaataaactaactagaatcccagattatcaacaaccattacttaacattcgctctttaacaaaattgacaactgtttcaacttactgaccaacagagagcccgcagcagaaaatactaaataaacgattaaataaaaccaatccccttctttcttcgtcctctgtatgtgtctcaaacccccaggcaaggttccaccactgcacctaccaggcaagtgcagtgcaagcagcagtaatgtcaccattatgacgtttccgatgaaacacgcgccaaatatccgactaatgcagggcataatagctgtctgggccggcggatgccttttctcgtattcaaacacacatgtcattcacatattatgtccaatagttggagtgtctatagggcagtatcgggagtgtccacacctcaaaatgagaaccggacaaacccaggaggaggtttttgacagttcacatgactacaactcccccaattatatcacatgaccaactcctccgcctttacagacccttgtagaagccctcgaaacctctcctccgtgtgtccccctaacccaagtgagacatgttccagacgagtgagacaaaggatagcgggctcaatggaccatcacgggctcataatatgcgatttttattataatacgtgatgattatcatcatttgtggttcaataccttcaaagctgcattgttttctatccgtatagcgcattgtgtacgagcgagtacagctacagttcgtcaactcaagagatgttccagggtgtcgctccaagtcagacatgcaccaaactgcttccatgcggcctgtgcagggcaaaaacaacaaacaacagacaaattaaacaggtggttccactcttaccaggccctgctcattcctgtgcaggttacgttacagtacaatacgaatctgtgcagaagagcacatagaagcctcttgagaagcacaagagagcacatagactcgcattccatgaatacattctttccatgcatataattggctaaaaaaagcaaacaggatcttctctgtagacatgtgtgactacagtaacctactgtacgttgtttgcacatggccgcatgtgttgtaggttgggttgaagaagacctccaggagaagaaggagagaaggagtgatgaccccgagttcaccaaacgtctccaacttggatcaatgagcaaccaaggaactttgatagtgttctggtaaattttgaggcctcaaagactcctcaaagacaccctctcctggacaccctaaacatgcacaactgcacaatgtacttggttggtaccaactcattgttgtctcaaatatatagtgcaataattgccgtagcgcacgcttttattcaccccttttctggctgcttcatgtacgatgcaaagaacacagcatacatatatttgcacagagaggagcccaacaactgactcagagttgagaaaaggaaaaagcaacgaccagagagaaagagagtacgaggaggtcacgtggtgcgggatatctcgtgacggtccaactagtatctggccaaagtttttaattcttcgggtagaaaacaaattatttgtgtgctttttctggttactttttgcccaaccttttggagttgtaccagagtccaaaagtgacgggataactggctgaaaagataattgacagtctcagatattgaagtgattgatttaaatacacattttttctatatttttgtagacaatttcattatcgctctggtaaacagtgtcagaagtcttgacgagagtgtatcaaatcacaccatgatctgcagatcgtcatgatacattggaatagaataaacatgataatatatgagagagttcgagttctggtggaactcggtttgttatttgtggtaaacggtgattggggggcatttagtcccatattcttcccccagttaagtaaagtgtcaagtattgtgttgcatttagataacaatttaagtaagtctaaatgtcagaaatcataacaattctgcttttgcccatatctctgtcaattttctagtaatttctaagaggacaagtcaggtttatttataatggtactagttataagtgtagtaattttttcattattatgcccccaattggtaaagttgtgatcttcatcacctctggtctggaactcactattctatacgaacaagaacatattaggagatggttgagataaaaattgagatgttgatatgtttcaatcgtatttttaaatcctttgcagaactccccatacttctggcttgtctccttggccaattagaagatgtatcattgaagacctatacagttacagtggaagaatgtagttggcgacttggaactgatttgacaatggaaagacgtgcagcagtaacgtcatctggcaaacaaaattcatgttcagaactcgtcatgtgtttgattggtcttgatagtccagtagatgcccctctcataggagctggacagtggtagagcatagacaggagtgcagaatgtattacaccgcaccggtaaacaataacaaagaagtctcggcttcttatacactgcttggtgaatatgataaagcgtctttcgcctttatatcagtttttgactattttggataggagttgattatgcagtcccttgatatcagatcttgagtttttggcacgtggattgggggagtcacgtgtatttggggagtcacgcgaaggatagcttggtcacatgagtctctctaccaatattcgtttcttgaagggactctgagaccaaccgagacagattggtactaccgggagcaagtcgattgtttggggaaatacgtgggcttggatcaatgaggcaatcacgtgaacagtctaaatgaatatatttgtagtttttacgtctgtagaacgtatttgttactagataatcagttcactgtgatcacaagtccagatctgacccacaaacatcttaccattacactggtaaatggagatatggggggaagagaagagtgataacggataatttgaagttattggatcttttgaagttattagacaggattattactgtctctcgctctattgttgcttgttaaccgttcaaatagatatctttgcttttgctatattgtatagtcgctaagaggaaacttggagacaccacaattacatggatacatggctttggtgtgttcaatggggcattgggtgatccttttgcgtgtataaatagttggtcaacattttgcttgtactattctttgtggcgggtatgaggcggactgtagcatgtattgatcaagacctccattattacttggagtatatattgataatagttaagttttagttgaaacaacagatgcagtatttctgatcttataatatatatccttacagaataaattgatttttatgtatttataacctatcaagaccttctatatgttctcattttatcctctatatctcgtgcaaatcgaatgtcctaccatttccaggattctatgtagcccatcaccatttttctcaaattacttaagatttagttagataaaaagttctgctgggggttcaaaaatgaggttccagacattctattgatacaggaatacgttcagaatgaacaggatgttcactataatcagatatgttttaaaattgttgtattttgttcccatatctagacaggtaggcgattctgcacaattctcagattcccatttagttaagctctagttgacattattgtagcatatacagtctgagttacccatgatgtcacaaacaagatgttcgaaatgaatgatactcgacagagtctttggccaactgaccatcttctttcaactctgggttacctcttgtagaccgagggaaccatattcctccatagatacttgatgtagctacgatacagcccaattgacaccataagagcccatcacacccataccaggagagcggctctattgagatcgttccatatggtaattattctccttgagccaccctcttggaatgggttccagtttacccttctcctttgcctgctccctgtccattgcctgctctcttgtccttccctcccccgctatcaactccctgttaatctccctgagctggcgataatgctgtttcgtcttctccagtttgtgcacttcctgctgaatctgttgttggagattctccaggcgcttctgtgttgctacaagagattcgttgagagcacaaaaggtggtgaagagctgcacatcggtttcgccggtgggaggagcgatttgtccgtctctgagaaccgagtgtgatgtgtcacccgggaactgatggctgttgaatgaagtgttcatggaaggctgaaggagtaaacaacgggtcactaaactacggtagcaaacgacactgtaaatacataacattatagaaatgttccctaaagaagagcagcaacaaaaacaatggcggcaccggccatgggaacgccattggaaacaccaacattgccggtagcagaggccgcagcagaatcggtggcagaaccaactgcggcggtggcagaggccgcagcagaatcggcggcagaaccaactgcggcagtggcagaggtggcagcagaagaggcggcagaggcggcagaagaggcggcagaggcggcagaagaggcggcagaggcggccgtagaaccagcctggccagccgaagaggcagcaccagtggccgaggcagcaggggcactaccggggccgctcacggctacactctgagagttagccttctcgttgacgtcatcatcatcgtcgtcgtcgtcatcgtcacttctgggggaaccagtagtgctgctaccagttgcggtggccaccacggtggggttaaaggttcgcgtatcgtcgtcgtcgtcgtcatcatttctggaggcaccagtagttctgctaccggctccggtggccaccatggcggggttaaaggttcgcgtatcgtcgtcatcgttatcgtcgtcgtcgtccccccagtcgctccgggtgcgccaggcggggttattggagtgatactcggccgcgatggacccaatggcctgattgacgcttcgcatctcctgttcgttcatggtggagaattcgggggacagcacaatgctctgaagcgactggtatcgggggtcgttgaacattcgttccgagtctccggcccactggagagcctcgctgacgtgctgcatatcttcagcgttgagcagtccggccagtccagccacgttggtggcgcccagaagccctgccatgtcagcaggtatgttgactccgtccagaagacccgccagctccgagggcatgttgggcaagttggggatgttgggattctgtcgaaccacaacgttggcaggaatgccggctgcaatcacggtggatacaagggtggcaattacgagagacatgggaatgagtctaggtcaagagttgctttggtgagtggttggtgagtggttggtgagtggttggtgggtcggtcaagagtcggtcaagagtggtgagtcgatttgatctctgttgctcactgattagactgtgtctgtgccaacttcagtaccacacatatatatatacctggccaagcccactaagaccaacaactggctccatgtaactgaggggagggggagaaacagagtttgcatctcgtatccacgtgtatatatagacgcatcatgcggcgtaaatcgaacgtctaatccgcgcggctgacgtctagaaggaggctatctggacaccatctggggcgaaagaggagcgacagagagacgcaaaaccgcaggaatggggtacgaatcgaaccgtggagccgagacgacgccgaatctcgcggtcacatgaccccgccgcccgtccccgcgccgttggatactccgttctggccgcttgctgtgtctctgcagctgtaccccaggtcagttgtaaatcccgaaccggtgaacctttttccacaaggggagtttcgggagttttggagctcaccttttggggcggagtgttgcgaggcggagttggaagcaatggggcttggggtcggggtgtatgttttgcactgcctctcatgtgatcttcaatcatgtgagtggtgagggagggaggacggagggaggacggagggatggaggacggatggaggacggagcatggaggaaggaggacggaggaaggaggaaggaccatggagcatggagcatggagcagtgtgtgctgtactacaaatgggagtgtactgtcgtactactaaaaggagtacagtagctacaatggatggaacatactacagaacatagattgaaccataccataccaacgtacgtacagtacaccactacaatgtagctcacttctccgacgccaagactatatcgcccagacaagtgctgataagcgagcatgaggacaaggaaatgggtccttgtagtgtatactgaatatagcggatttttatttttgcccctgcttttggtcgatgtggaattggtgggttgaatggcattggtcgctgcgttggccatcggatttcggcgttaggtatagtatgaccaagtctatatatatatatctagagtatatattacactacttgtagatactctactgtgctgtacttgtaaaagttatatatagtcagagtaaaatctgtttcatgaaaatatctgttccaaaaaagtttcactcatgagctcatgagctcatccactgctcaacaaatgtctgcttcgccatcgccaggagaatgtaggttgcaggtggccaatatgattatccgactcatgcagggcttgtttattggagcttttattggttactgtatgtactgttttgtacttgtatttggtgtcttgttgctgcgagttttttgtttcttttgttctgttttgttctgttttgttctgttttgttctgttttgttctgttttgttctgttttattctctttttattctctgatacatttttattcattttactcagtttattcactttactcagtttattcactttactgtttattcattttactctgtatattcattttataatttggaccacagaagtggtagagtggtaaagcaaatataaaacaacactatacgccccaaaacacgggctctcttctggtaccaagcattcccccatactttgaacatgttgccctttcgccagtgatctcaacttctggtagacggctagaccggcggctaaataaatgatgctcgagagctaatatttagacgagccaccaagatgcatttctggagacaatggggttggatcgtggcacgtaaaagtacataactcggttcttttactctccagcatcagattcatctttctacaaactcgctggcaccaataatgaccattctagatagaccccaaattaccccttccatttctccaactaacttaaacccccctcctctaaatagtgagcatatttcttcatcataacaaacacaatccaagacttcgctatcacgctacagtaccaccctacaccgctacaatggactggaaactgcagatccagcagctcgcgagccgactagtcaagtgggtgaccaacacccagcccgtgattcccaaaaacgttacccaaagaacgatagatacccaaaccgataccaacacgtccaccactaccaatgcttctgagaccaacataccaaatgctcccgaggcggccgaggacgaaaccgagtccagaccccagtcgtatggttctgtgtcaacccaagactcgtatccagtgattccgctcgtgcgacactcgactacaagagaacatgttgtttcacgagtggttttggtcggcgcagaggagttgtttgatgagggggttgagagagttgtgtgaggtgtcaagtgtcaagtgcgaggcacatgtggatgattattgccactctgtccactttccagactcacactcagtccctgactggctcttttgatctggctcccgaccaaactggaacagtgaagtatcaacatgtcactaaaagctgttggaatgatagttgatggccacgaaaaagcctctgatacctatatatgccccaatttcagttaacaaatgagttctagcagcccctatacatctcatcgtccccaccaaatacgtctcatcgtaacgtagccccaaaaacatcacctaaatcacttaatatagatgccatatacttgaaaaatatcctacttcatccccaaccctccactaacaactacctcatgacaattaagccaattaatcactatcatcactacaccgcccacaataccccgtcccagatgtcctcaacaaactcttaataacctcctcagtcacttcaactaatctcccaactaccctgagttaccctacctattattagacacatgtctcatgcacgtcttttccacctccaaagctgccatcaccacttttacatcaccaccatggagccccaaacgaccgccaaggtggtgctgacgaccactaaaggccccattgaggcggaattatttgccaaagaggtgccgctggcttgtacacgcttcctgcagctctgcaagtccggatactacgactcaaagccgttctaccgagtgctgccgggagaactgatccaatgtggccaacaggaggctggaaacaacacaaacagctaccctaagcttaaagacgaaccacatacccgaatcaaactcaaacgaggctacttggccatggctagcgaatacaccgagaacaaccgacgggtccccaattctgccaccacggagttctttattgctctcaaagaaatccccttcagcggaactgtgattggaaaaatcaccggagacactatttacaacgcccaagatatcgctcgaggagaattgaccgaagatggatacccgatgtacgttcaaacggtgcagaacgtggagatagtgctgggaggagggctggtgcaagagacacaaaaggcgggcgccgacgcgggcgccgacgcggagtcacgtgaaaacaagtctggttcacgtgatagaccgaagaagccaaaacgaaagcttcaggtgaaccatgacgatgacgacgatgaggagcctgtttttacgaaaaagagtgtctccaagctggttgaagacaagttcaagaaggacaacaccaacgtcgcaaagaagcccaaggtggaggcgtccgcggaacaaccggaacctgctgccgttcaagcaaccaccacccatcacgtgcaagatgcagaagacatgaccacagaagttgacactgttgtttcagaacggctggaaaagttcagaaacatgtcacgtactaagccagacacaaagcccaagtccatgttaatttcccaagaagacagaatcagacgacgactaggactaggtcccgatgaagatattccttcggatgcctcggacccttcgtcagatgaagatgacgattttgacattttcaaacacaaattcatttgtccagaggacgacaaggccgaggactcgttgattactttgggagcatgaccgtgaacttgacccattcgtacatattatatatttattttaaagaagggatgtagaatgtgagcgcacagtcagtctgtcattcggctcacaacactttttcatcaatctaatcaacagccaaactactcgggcctggtccgtctctttcctattatactatacaaatctgtttgtacatacgtaccgtcttgtatgcctccttgcatctctctatcttcttcctcatcaccacaaacactactctaacgtagttttaccttgtggtgatatctgaatgagggggggggggggggggggggggggaaaaggggggaaatttaaacccccccttaaaaaattttaaaaaaattaaaaaaaaaaaacccccccccaaattttttaattttttttccccccccccccttaaattttttttttttttaaaaaaaaaaatttttaatttggcccccaaaaaccccccctcttaaaaaaaatttttttgtttatttgttttaaaggcaaataaaaaaaattaaaaaaaaatttctcaaaaattttttttaaatttttttaaaaaaaaaaaatttccatccccaaaaaaaaaaatttttcctaaccccccccaaatcgcgcctcttttttcgcgcgcacataaattttccaaattttttcccaaaaaaaaaaacttcccccaaaaaaaattttcccccccctcccttttttattttttttttttttttttttaataaaaaaaatttccccccaaacccccccattttttttaaaaaatttccaaaaaatttttttaaaacccccccccttttttcccccaaaaaaatttttttattccccatttttcccccccccttaaaaaaaaacccttgttaattcaaatttaccctaaaaaaaaataaaaaaaaaaaccccaaaaaactcccctccccccccctttcccccttttttcccccccccccccccccccccccccaaaaaaaaaattccccccccctaaaaaaaccaaaaaaaaaaaaaaaaaaaaatccccaaaaattttttccccccctcccccccccaaaaaaaacccccaaaaaaaaaaaatttctcccaaaccccaaaattttccctttttttttttttttttttaaaaaaattattttaaaaaaaaaaaaacccttcccccaaataaaaaatttttttaaccccttaaaaaccctccccccccaaccccccttttccccccttcccccccccaaaaaaaatcccccccctttcccaaaaaccttcttttcccttttttttttccccccccccccccaacaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatccgtatataccatcgtgctacagctctcttcggccgaccacgctccgtcatcgcactgcgcggctattgtcagtggctgacgtacatgtgtacatggctgcaagttctataatgcaatgacaagaaaaagaaaaagagaagaaggaggggagggggtgggggagtgtggtgtatatagtaaaaaccaaacaaaagaaaacaaacctacaaatcacctttatcattcagacattcatcatgttccgtgcccgaaagcgtggagggagggggggggtgggggtatgtttactagtattatttattgtattaggggtaagtgtgggggggtggggctgtcaatgtaccagagcgttaatggcagcgtgtccgctgtgagttcggggtggtttctcgtgttttttttgtggggccccacatgaaaaattttacgctatcttgtgtgtttgttttttaatactctaccccggagatttttttgttcccccccccctcatgttttttttttttccgggaggcgccgccccaaaagggcatttttggagggttcttcaaaaaaggccggaatctcttttcgtcatcgataaaaatctctctccggatttactctacctaggggtctncnnagttttttcctctcaaaaaggnncccaattttttataaaagggggggggaattttgtggggnnccgcaaaaaaactccccccttccctttttttttttttttttttttaaaaaagggggaaaaaaggggggggggccctttttttttttttttttcaacaatttttttttttttttttaaaaaaaaaaaaaaaaggggggggggggggggttttttttttttttttttaaaaaaatttttttttaaaaaaccccttttttttttccccccccccccctttttttttttttttttccccccaaaaaaaaaaaaaaaaaattttttttttttttttttttttttaaaaaggggggggggggggggggggggaaaggggggagagtctaaccacgactctaaaagatgtcacaagagtagagataatagagaccctacccaactttatcagtagttcagtccacccacccattcaatttgctgctgctcatgagcgacagttttagtatggcgccccagcatcctccctcgtgctaagcactcgttcggttacttggcttcactggcccatccaacaatatcaataccactcctgccacactttcgatccaccttgatatcagacagaccactggcatcgtccaaataccgatgattgctcatgccgcccgcatcggctcgctgttggggatccatctgcagcattggcagcagaaagctggccagcaacttggcctcctccttgctatggttgtatttctcatgcagaactgcctccagtggccagtccttcagcttggagatcttcttgagctcgcccttgtcgttgaagtactctgacgtccatttgccggtctgcagcacgctggtagggatcttgccgagcaactcgatgatctgcgcaatgtggtcgtcgtccttggagtacttggagccggtctggggctcgaacaaatagtcgccggtcaatagctcaaacaccaaacacgacatggaccagatatcgctgctggcgccccagaacgagcccagcagcacctcgggtgaccggtactgtcgcgtctggatgtcgttggtgaagtgatgctcgacccagcacgcgttgccgagatcgacgattttgacgctgatgagctcctcggccagcgcggttctcggcttggtgggcgataccgatgtggggctcttggacagctggttgctggtctttttctcgtggtcgtcgtcgagtcgaacctcctccaccatcttggtcatggtgagatcgttgaagaaggacgcgttggagcgcagaggagaagggagtggctgggagccggtgatgagagattgtcgtcgcgatctacgaccggttctggacccgggtttggtctttttcgtctcgaccgccgcgcgatcctcctcctcggccagcttaagcatcttctccacgtcgccaatctcaatgagcacgttttcaggtttgaggtcggtgtgcacaatgccgcattcgcggtgcaggtagtccaggcccagcaacacctgctttgtgatctgcttgacgagcttgacggggatgccggcaaactggtgtcgtcgaatgagacccagcagattttcgcccagcacctcaaacaccatgcagtagtgtgtgccgttggggcccacgtgcttgaagctgtcgtacaggcccacgacatgggccttgcctggatggtcggggttcttgctgctcacccgctccagcattttgatttcgtcaatggccgtctctgtgtagtgggaagccgaccgcaccaccttcatggccacgtggcggtcgttgttctgcgtatcccgcgcgagccacacggtcgagaagtgtccccagcccagcttgcgcacaatcacgtagcggccgttggcaaacttctcgccgatcttcacgggatggtagcctccgggacagtagtcgtccagcgactcttcgtttttctgcagcacctcgtcctccgagtcgctgaggtccgtgttgacggtgagtttcgacattgtgtgcaactggatatgtgatgatggtcggtgtttgtgtcgtataaccacggacgagtactttttttctggtggatttcgtctcgactaggctggttaaaagtgtttggtgtaaactcgggggtgttgtgctgtcgcgctgtttatgtaacgtcggtttgtgtctgcgtcacgtcgtctgtgtctccaactgagggtcgcacgttcaacttgtatcagtatgtcgtctggtcaagtcgtctcagagtacgagttcactagatatcgccaaacttgttttgattttaaagttgcgcatgcatggcgtgctgtggagggccttgaagggggtccaaagagggacttgtagacgcgctagagacagagaaaacccgccaaaatactcgcctaatttttctctcctgatttctcttttcagaatcgcgctgggacccccacagcccattctaaacacactctcctgcaggtgcggcaatctaccctccaacacgataagatgagctcatgttcataacaccggttgtagaggcccaaaagcggcggaaaaacggcttttccaggtcaattgccaatcggagcccattgccggagatttccgccccgccatttcttccccaagtccccgcgtaaccctcagccctaagtacatcctgtcacgacccacttaccctaacagaaaacacatcccagccacgcataccccatgcatccacaatggcaaccctcccacatacgagcaactcggcgcgcttcttgagattaggagataagccagaaagagcgggacaagtccgttggggtggggggataagtgtgtggaggtcacgtgactccttccgatgggtgtaatctgtatatttttgacgactctcatgcgggaacatggtggtattgcacttggagagtatatataccctgctatacaggagagcaagagagaacagttgtactacaagtggcacaaccagcggtacttgtactctgtagaactccgattgcacaatttccacatgtacctgagagaagtaccatctgcctcttgtctcggcactggctggtgtcttttgttgtttgggtgacgtgtttcagatgtcttgacgagtacgagtacgagtatgtacgagcgagtacaatacacttggatacgatgtgatatcgggcagaattagaaaaatcgtgattttttggaaaatcgagtaaaatagattggaatcgggaaaacccccgatttgataagagtcgattttatatatatattgaaaattgaattgcacaggtttcgagcaacgcggccattttgacccctttctataccagttgtttggaaggcctatatggtcaatattggaataagatgttttttagagatgacaattacgtcatattggaggaacataaaaaggcgtatgcaacggacagaatggtggctcaacaaactagaaaagactatggttggaatcaacaaatcaatagctctcgatcggtcaaaaaatcatcgtcattttggcaaaactggcctcattagaagccctctccaatcccttgtctcatggcaaaaagtaacgatcagttagtaaaacttttactacagtacagtacctgtagtgtgacctgggtcaaaaaaaaagatggaggtaacaaacagagcgggtgtcaagtctacaagtgcattattggaacggaaaaattccttaaatgggcatttctggctactatacatacatcagtcgtctatcaaatagcaacgaatctatctcacgccacagaggagatattggaaatctgacaaatccgtccttcttttcatgcccatttcaatcagtttatcatctctcggcgtgtccttagccctcttataaggtgctgtttgttcgtcaccatcagtcagctttcagttggatactgaacgagtatgtactgtaccgtagaagaacatcctggggtaatattggccaactgactctttcaaccaactccgaatctcatctaatccacttctgactctttcgttaccctccagctcacttattcgtctcacaacctcacccgttctctttagcagaggtactccttcaactccagaataccatatcaagagccatatatttccatatccaatggtatcatttgcacgtctcccagatgcccataccgccagttaatcgcatgtcatcaacagtccagatccatgacacccccagcccatgtatgactaagcaggtggcaatcaataccactcaactcatctgtgggccctaaaaactccatctccccctcttgtagagccgataatgacccccttcactccgccttttcgcatactcttaacctctatgtgcatgcacatcgccacttaacctaactgtagtgacacgatccagcaccactcaaccactcaaccacacaaccgcaatcacaacgacaatgtctccaatcgcatctctggaaagcgcatacaaggccggcgactacgaaaaggtggagcagctgcttctgccccttaaggtggacatggccaaaagcgggcttctgacgtcgcccaactcgtctggtcattcaaaggcggacctggaggcagctcgaacggcgctcgagattggcgctctgtctgccgtcaatctgggcaaagaggccgaattcaccaggtttgtggcgcaatcgcggcagttttatggcatccagggtctttctgcgtcgccccacgagtccaagattgtggcgctctatctgctgctgctgctgtcgcagaacgaaattgcgcagttccacaccgagctggagtcgttggactttgacacggtggaaaacgacaagtttctatcgttccccatcaagctagagagatggatcatggagggagcctacgaccgggtgtggaaggccatcaccaacaaggacgctgttcccagctccgagtttctctgtttcgccgaccctctagtatttgccatccggggtgaaattgctttgtgcgccgaaaaggcatacacctcgctgcctctcaacaatgctcgacatttgctgtttttcgactcggaccagggcgtggtggactttgtgcaggagcagcctggctgggagatccacggtgagcgaatcaccttcccgggtgttatcagcgaggacgccactctgaatagcagaaaggtgaccgagaaattgattggaaactcgttggagtacgccaaggagatggagcagattatctaagggagcgacaaatcggagatacgatacggaaacaacaatctatcggtacagtaccggttcgggcgaggatctcagtgtcactaccatctgtgatctggcctgaccatgatgaagtatgaattgttctagatgatgcatattataatgagcagaaagtgtgtagtgatagtacggtacgtgtattgaatgaggaaaccgccgtctctcatctagtgtccttctaaggtgaattgtcgtagggcgatgtacatacgcatgttgtaggtcgactgttgtacttgtggtcacgtctcactcgactgtctgggttttattacaaataattgatgtaaacaaaatgggcaagaccagtgcaacagattgatactacttgtatctacttatccatggaatgtctgtggatcgtgataagggtcgtttgaggtgatggaggattagttgacccaagtcacattttacttgagtttacttgggtattgtaacaacagccgttgtctaaataaaatggcgtcacggaaataaatgaatgtatatgcagaaaaaacccagtatcagcgtattctctgatctcgggagggtacaatgtgtgtttcactactgagagtgcctagtaggaaaatgtccagggcgcccttcttacctaattcaccagctacagctcagaggcctgctgctatcttgatcataatgcattaaccatttccttagtgtattgaattgctgacgatactgcacagtcatgacccgttatgagatgtaggagagtactcgtagtctcagcgacgggcttgactacgttcgacgcacgacttgatcgctgaagtagttcgcagtagccaccgtctacggcccaagagacccacggaacattgcgcccaagtcaccgaccaccgaaggtcctgtcacaagactatgtctcgtcttcccaggagagtagtctagacaacccatcaaatgagtttgcgaaggaggtcatcgccgaaatcacccaccttgcaaatatacgcggcgttgttcaccacgcccttgttgagctggtcggacttgtccagctcggtgcacttttccaaaaaggcgagcaccttctttcgctgggcctcatctaacttggcagcatgaacaccgacaacggtggtgattcgcatggttcggggggtaatgggcccggccagcccgtcgattacatggtcaagcatgtctcgatccatatccgagcagtatgaaagggcggtttgtagtacagacttgatatgagcgtctgcttcatttttgtaaaactgggctcccagggtcttcaatagagcgtcagtgtccttgtcagagacgtgtttgacgacattgagcagaatctgggctcccaaaagtctcagttcgggaatgtaagggaaagccagcagattggtaagtccttgtttgagcagtggactagctgccaattccacacaataatccttcttgttggacgccagtttgaggaagtggcctcccgactgcaactggtccgtgtactggccagtttggagcagaaacagcgactcttcaatcagatgcgggtactttgtcagcacagtggccagatctgactcattagtaatcagagtactagtcaccgcaatccaacaggagggcccaattccggccaattgagggtcccagaacttgagatctttcaattggtacacaaactcgagctggttcatgttgataccttccgaagcacacaccagagcggtgtagagggctcttctgagatcaagaggggccaaaagagcgtcatcgggattgtcctgcgataaatccactaccagcttgtacagtttgtcaaattccaccatctttcctgtttcctcgtcgttgaccatgaccagaagcagctctgtggctcccggaacattggagtctttctgggtacaattcagcagatattggtagaccgccgcgaggattctggggtccagttttagtcgaccaatcacccacatttgcagcatggtcagcagagtgcctatcgatacaaagtcggtatctgtcagggtttcaaacagcaacaccagtccctgggtgaactcctgactgtgaaccagttcctccttgacgtcggggtcttcgccattggcccagttgaagagcactgccgagtagaagggaagggccatcgagttcttagtcttcaccaatgagctcatgtagtgtctgaaggagtcctggttgagccacacgtccaacaaaatggctctattgacctcattttcactcacgcagttgccgatgatgcgtaagtaggacacaacaatgaggttgtcggtggatgcgggtagatcaaacacctcgcagatctcaggaagcaccttgccaatgtccgactggtactttgtgtctctgagagtgactgacagttccgagatctgctcggcagatccgacggaaagaacgccacttttgccgatcgtttgtaatgcttgcctggggtccattgaagagtgtcaaaagggtgtcggagtcgtttcacagctgatacggtccgcttctcacaactgctgagtgtagattgctgtgccaggacactgggcaactttatgcatgcaccagagatgggggaggggtcatgtgctggggcggttacggcgtccttgaagatgattggagggcacaaaacgacatgaaacgggctggcgagtccattaaaggcatcgccaaggccccagctgctctacagggcccacaaaactacacttgctccgattctccatatgcaccccctcataagtttaaaagaggcggagaaaactggctggaggtgaagaagggacaaacagctgatttttgttgaagctggccgggcagaaaaacccgcttggttttggtagccggattcaggcggaggatcggcccgccatctacacaggttatgaccacaggttacgagcgggcgatgttgacccggttcagtctttttcgagcgttttccttggtttgggtttttcagtctcaccagtatcaatgcaagtttgtagaataaaaaataaataaggaaagacaagaaaataaaataaaacaaagaaaatcaaataaaatcaaacaaatcaaacaaatcaaatcaaatcaaaccaaaccagataaaatcaaaccaaaaaacaaaacaaatcaaatcagataaaataaaccaaataaaatcaaacaaataaaatcaaacaaatgaaatcaaataaaatcaaataatatcgtttaatactcacaaatcggttcgccctgtagcatatatattaacgtttcggttaggacaaaatggaggaaaataacaagtcgggctatcttgctcaatattgatcctggaaacaatctgagtgaacaattacgataagcaagccccagcaatccttctgatatctttatggccccgattgagccaatatcaagcccaataactggaccaacctaccccacccacacaaccctaatttaccaacacgtcacgcgtcatacattaggtatctacagcacatcactcttgtccgacaaacacacacaccaacccaacacacatcatgaccaaggccaccgaaaccgcttttttctttgtggctctaattgccgtgtacgccgctctgtggttcggcttcattcctgtcggcgagaagatccgacaggagattgtgcctctgctgcctttctggaccattgtttcgtttggctcttattctctgggtactctgggctgggatattctgtccttcaacgacaagcccgagaagtacgccgagctgaaggaggtgagtaggagaggagaggtgacaaggttgcatttcgttgcgaatatgtgcagtgcaagtgtgacgtcctggatggagatgaagtgccggagtggatacggagtatcactataccagagtcgtgccattgtgtgtgattttgagagggttaaactgtggtgacttgacagcgctcttaatgacaagtgctgactgctcgaatcaaatatggcagacgtgccatgatctgattatggcgcgtgtttacgaggcctgtggctctcagacgtgacagtggtaagacaatcactatagtacaagcccttgagtggtcagactcctcacctgcccaaagtccagtcaacgacaactacaagttctaggtgactcccgactttcgaattcggcctcccctcgtctcatgttccctactaacccagcaaatcaagctcgcaaaggccgacctcaagtccaagggcgtgtctgtttaatatagaaggataatacacgagcatcatcagcgacgcggatcgtacttaccacaatagagtacaaatatcgagtattgagacgtgtttactccgaattttgtatctacacgacactctgaaaagttgccgaaataataaagatggcacgaagctcttgaatgagtcttttatcgtatcacagggacaatacgacgagaagtccaatatgtccgaaatgaaccattggccttgtagaatgggattttgaaaggaaaacagacaagaaaagacaatccatgaattctacagggttccacgacattccaggtatctcttttgatccaaaaccccccaaattccgcttctcacattcaacaacccgatctccacgccaaaccacgactcgtacgagtaaaagtcactccaggtgactgacgaaatgtgcatcttgatcgtctcatcgagctgcttccattgatgtaggccatggtccttacgttcctcagcccagtgtcacgaccgcctggttccttacaccagtaccacctacagccctacactaatagtctataaatctattgttatgttgaaagtctcggtatgctctcgttgtcacattctataacactgtagttagagcgtcttgatagcagccttggagaccgtagcatccagtacgatagtaacggacaatgctgggatgcggccgtgggggcagagccagtcacgtgactttccaaacgcgcacaggtggacgatgcaagtctagaccatcattttgttgttgttgttgctgttgttgttgctgttgctgttgttgttgctgttgctgttgctgttgctgttgctgttgctgttgttgtcttcagactaaatgcctgctagggctttggccattcggttgcaagtggttttaggcggtggcctgctgctgttgtgcagcgccacctcccatctcctgcaactttttggcctgtttcttctttcgcagtcgcttctcagtatccaggaacaccttgatagacacgtcaacgtcatcccattcatccttagcctcggggtcattggctcgatctgccggtggggttccaaagtcggccggccatgtggctcctggcgtcttcatgagcgcctcgtgtgcctgctttcgcttctcctgccagtggtcaatgtcttccttgtacatttcccacacgcagttgatacatccggacatgcagcaattttcgggctcttcgggtctggggggcactcggacacctgcaatcacccgggtcagtttctcggcgtcttctcgtcgggcctttcgagatcccacttttccgaaaaccagctcggctctctgctgggccgtcaggttgtcgtgttttcggtcggaggtatcaaacgtgagactggagggttttgagggagaaaaggtctttttgtggttggctcctttgtggcccactcctcgtggctgttttctttgtacttggttagtgaaactggtttttggcgggtcttgtcttgtcatctccaatccgtcctggacggtccatctggtcactcacaatcgtagaaaacataagggttcttgtgaaggctagccgaggtgctaaaccgtcgtgccgcgggctgtacttgtgtaagacgcgatcgcaacatgtttgtgtgacagtaatatcgcgtgcgcttggtcgtatctgtttcagtggtggtcctccggtaccgtcgctacctcactttttatgccaatcagcaattagtaatatgcagaagcaaatgaccgtctagctcggccgactctagtccggggggggacatggatggacatgacatgcaggaagcagagcaggtgacgtcatgactaatctacaaaccttgcgtcctctggctagaaccggttttggagagtacacggggcattcttgtgtgcgtttattttgtcttgctccgatttttcaatgcctatcaaactcgcatccaattttcatattagtttttcagtgtatttttcaccttttttgactcatgtttatataattttttaatttttaattttttcatcattttttcatcattttttttaatgtttttaaattcatcctttcgtccagttgccctttaactcaaccagactctgctcactggtactcctggtataatagaagcttggatcaacgctaaattttagagatattgcggttccgaaagtgaataaatactcagccagcttttctctacaaaatgatacaattatattagtaatagacccattgaaaggcagaaaaaagacgtacatcttgtattcaaccattcacttggacctcttattaagctgtaagcacagctaggcctagaccgaggctaccatacatacggtgatactactgcgccgtacaagtacaaaatacaacgcttgtgggaatattaagacgagcctgagataccgaagatgactaatatcaacgccgggaccacgtgactgaaccacgggatctacaatggcatcttgtcttgaggttgtcaggttatcgtcagatcggatgtgccattgtagatcccgagcttagtcatatttaggagaacttactaagctgaggcattcctatcgttcccaccacaatcaccaatcccacgctccacatactcttttagaaacattatatatacggcatcttttactgttttacctgtctactgattatactccctcccacacactcctctcgcactaattaactttcgcctcgaggagccagttgcatacagaaagcaagtggcctacaagtacttgtaggtgtggaattggaatacagaacagaacagaacagaggagatagctattcaacagcgactcgaaagggatccgacagtgattcgacaagtgagacaacagcaccacacaatccagtaacgacacacaaccgacggccttccatccatctcctctcactcatgctatgacccctatacactcagaccctctacaatgtgaggctgtctctgacgaagacagtcatggctcgataaaggacactgtttccagtccggtatcaacacaaacacagacaaggcccgcccccgtcctccgcccgaggaaatcgtacaattcggcccatacaaacccacattcgcctgctccatacgacactcctctgttctcctcgctggatgaaatgccaagcgccctccacaacctgtctgacgaatcgctggctaaaatgatcgaccgacacggaggcatgtttctggtacggcagctgtcacgtgatctggcccaacgtgagaaggaagtggttgtgatgcgaaaacagcacgaggaccgcgaacgcgagctcaaaaccatgctggtggaatgcgacgtgtctgtgattgagattgaacggcggctaagctccatgcgcgtcaccagtgtcgttaatccggatcacgtcatcaacgaggctctacaggaggctctagttgatgttcctcaggaatccgaatccaggagtctcttgagtatcaccaagactctgtgggacagtcctcgaagtgcacgctccctcctttcggtcaaatcttcttctgcctcgctcaaaagttttatggacgagggtggagacggcaacaactcgggttctgcagttgtttccacttccgcaatcacaacttcttctacgacaacaaacacccgtgaagaggaatactcgagtgtcaagaacggctcgctgaacaacgacacagccaccaacatgtccacttcttctgaccctcccagaagtatcgaaatgacatccatcttcgacccctccatggctcctccgaccctccaacagtcacgtgacctgctcacagacagatacggcttcaagtatgactggaagcgatctcaaaaagagtccgctcgaaagcccgtctccattcatagcacggaagacagcaccattgataatacttcttcttttgagccggttaagagctccagttcaagtaccagcagttctgatcagtctaaaacaaccacaaagtcctcagaatcgaaaacaacttcaaagcctatctccagtgcgtttcaggaacccccttcgagaagtgctcccactgctacagtctctctaaccaccaatgtcaacaacaacagtgtcagcaatgtttcgaaaaacacacccgtcaaactgcttctttcccagctcagtcacattcacgacactcagcaaaaggctcaattacaaaactggaccgagttcctcaacactctctccaccttggcgtctgaacaggatgaaaatgcatgtaccaatctcctaggtctcggcggcgtttctctccgaccccacaatccaaaactgtacaagtcttttgtgtctcttgttctgggcggcattcctgtcaaattgcggccccaaatctggtctcaatgcagtggagccgagtctattaccattcctgggctgtaccaggagctgcttacagacagcaacagctcagccacagactatgaccccatagctgcgcagaacacgtcgcagatcgacctggacctgtaccgaaccatgcctcataacatcttctttggcaagggtccgggagtagccaagctgcgaaacgttctggtagcggtatccagacacaatccggacactggatactgccaggggatgaacattatggctgctgttctgttgctggcatttcccacagaggaagatgccttttgggccttggtggccctcacaaacctgctgcccacagactacctggctcctcctttactcacttctcgtgctgaccaaagggtgctcaaaagctacattgtccagcacttgccccaaataaatcaacacatggaccagctggaaatcgacctcgaagcaatcacgttcagctggttcctcagttgttttgcagacacgcttcctccagaggtgctgttccggatctgggacgtgtttctgtgtttggaaggtatgtcgttcttgttcaagactgctctggcgttgttcaaaatgcacaagtcgcaattgctcgagtttgactcggcagccgacttctacacgtacatcaaaaatgtgggagacaaggtgctgtcggtggacaatctcatcaagaccgctgaggagtttgatatcactgaggctgacgtcgagaagcgcagaaaggctgccctggctgacttgcagtgatctattacgtatttatgaccagtatttatcaatatatttatatcctacaagtgcacggatctgcccaagtcataacgagatgcattaaatcatgtaccattatctatatttgctgtggggggagggagggagataacaaaccatctttgtgagcaccacgtctcaagagaggtacgtacctcatggagatggatggcgttgtgcgatccgataccgcaccatgctgcgctttggactagcctccttagctgtccctaatctagttctgcaaagaaacccttgtaagcattatcaagatcaaacaacaactgtctcgattgatcatcggtgatactctccgtggccttcatattgttcaacgtgattaaccacttgacgatcttgtctcgtcccgcgaagtccttgttggtcaccttacccagcgaggtcatgaggtctcccagcagaggatgcagctggtcagtggcggagtaattgagcttcagagcgtccatgcacgtaatgaagttgccagtggcctcggcaacagctcgtgacgtcgaggggccttcccctgtgggagtggatcgtcctcctccgtccattcccccaatgtttgttgatgctagtgctgacgatgcctgggaagcaatgaccacgctggccgggattcccacactgattctttgtgttgccagcgaacagtcgagtccgtacttgtccttgaaatgctgcaacgacacaaactcattctgtactccttcgtccttgagcagggtgttgtattgagacagcaaccgagtgcagattgacgagtagtcctgttgcgacacagagtctttgagaaaggccttttcaagataatccagggacacaataatcgagtacagctccgcgaggttctcgtatcgttctctctcttttggcgaagagtagagacgcacctcctcgttgagagaaatgttggagctgcgctgtggtggcatatgggttagtggggcgtatggaagtgacatggttaatataggccgttgcagagtgtcgactcgtatttggatttgtgttcacggctgtatttggtgtttttcggctgtcctctgttgagtgagatggagctggtgatgtggtgatattaagcggagtagtgttaagcagctctcatgtgaggttgaagtttatttggaccatttggaggtcaagtaaaatacccaagtatctagttgggatacatgtgagtggatgaactggttaggatattttgcggtgacgatggtgaaactaacatgaacatacaaaaaagggctcgtgtagtcgatctttcaactatctagcgttcgtcatctatcaatagtcggactatgaaaaaatttcagtctgcggctcagaacgtggtcaactgagcgtgatataacgccatctgagacatgttgaatctctattctgtcctcgagtccgttacaaccaggattgtcaagtccccgattacctctagcttcatactgtcgtcctgttatgtggctctatgtacttctacctcccacgggaccgagaggtaagaccatggagacacgaccttgatccagagatgtcttacactctgtgtacttggcagaattttcatttcagtcatgaactttccctgatcggcggttttggtgtcgtacgactacagtacccgcactgtgtactgtactgggtatacatcttgtcctagtccgcctccaaacccctgacggaagcactgtatctagcaagcggctccgtggagttgcaatcttgtcattcgacagcttggaatgtaacgcccttgagcacgtgttttgaaaaagaaatgcgacatacatagctcgtgctggccaaatctgcacattgagagcatcagtcggcaaagcatcagtgcggctcctacgcctggtaatccaccccaagtcttgccgaagtcacgcatcgagtagatatgcacagtcgcgggtaacaagcagggtgttacatcaggtacgggcaggtacgggcaggtacgggcaggtacgggcaggtacagatcaggtacaggccaggtacaacccgaagcgtatagctcagagatgttacgagcaatgggacatatatttcgacccgatcaagcagttatagccactgtataccagaagcagcggtgcgtctagcttttccgctacaaacatctccatcgccaaacattcagttgtacagtccttggatctacaaagacaggcaggtgtgcagatacactattggacattggattcatgtgtgcagtaacaagagaagtcaagtttgtcaacaaattggactgggaaaggtgattgcagaggagaaatcgatcgtctaagcctctttcgagacaccaagacaaaggttctattcagagttggcttgtgcttgttcgagaggaggggggtttgagatgaggggtgtggggagtgttggcttgagctgcagattacattcagagctacagaccggtagagcttcaacagggaatcggaaatgctgcggtgcaggtctcagatagtgcctcgtattgtgttaaacgtggttttagaattgggtgggcgcgtggaggaggtttggcgcattgtgagggcgcacgattgcggtgtctatagctgcaccaataataacactagaggaacgccgagttgaaaaatcgattaatgaggtggaatagatgtgatttcggttgaaatgtccacgaaaaacaagcttgttgtccactcagcgaccgccatgtttcccgcatctccggtacatgcaactttaagcaagtctcagaccaccaggcagaagctgaagagaggaccacatagggttgaagccgagatgtgtgagggagaaagttcaatcaggtgataatatatcgctctgtggactccattgtcaaccatgctggcaactgtcaagagttacgttacgaatacgatctgaatatggaccagtcggactgtagaaaggtagacgccgcaggtataaagatcggttaccacttccgttattacaaagatagacaagcaaacgccatcaagtgtgcctacagtgccaagagatgtctacaggaaccagtattacgtgaataagagccattggttgtaccaagtaggctatattaacctgccaaagtggctacttgtagtatgggctgatggggtacacggtacagacgagacgagacctcggtgtttgtagagcaatgaatattgctttagagtagagtgagaaaccacgtttgattgattagaagtcctttctgtagatccgtgtagcaactatgtctgacaagctcgtttctttttccaccggtcgactatgcgatggcagatccaatctcgattgtcagcgctgtcatctccatgacaccgaaaagtggcgtcactagccacactccaggagagggtctcgcatgagcgcatgagcgcatttaatgtagttaatactgtttgtgcgtgcggtagtgtagtgcaatgtgtgaacaagagggacaagagccaaggacaaccctgtcaggttcaggtccggtattttcagcatctctgcactccatattttaccgcagcaggttgcagaggggcatggcaggacaagggctgtctgcgccagttgtgaaacaagccgcttgtgtgtcgcggtccggatatttgctcttttttacttcaatatacggttgctggcaatattccgaagtccgagacatggatgtaggtgtataattggtgtacggtgagcttaagagtgtcggtattgcatgtacccccgagaggtgcactacagtgcggttttcgctgggcagccccattctggctctctcaagacccccaatcaacttctccgtccccacatttcgcctaaacatgcctatccggaaaattctcgggaggtgtgcagcttcactcaacctttttcccagacaaaagcccagccaaaaggcagggagaccctcatactcaaggttgatgcgggagtggtctaaagatgattaggttgggcttgtaccccatacgagttgcagcggcagatggacaacaagcaaacaagtacaagggaaaaaagaaacaaggggcagaaataattggtcgcttgagaaagaaacaatgaaagaaataataaagaaataatgagaaacaatgaaagaaataatgagagaaacaatgagaaaaataatgagagaaacaatgagagaaacaaatgaaagataccaaatgaaaacattgacaccgttgcattgcgtccgtccattgtcctctttttcaaatctgcgacatgataatactggtgcagtacagaatcttgtctatacaagtgcattacctactgtacttggacaatactcctgaagcttggctcaacgtcggcaggtccaaggggtggctggctacagcaacatggcctgatactgcaggcttatgttggtttaccaagcggatgagcacgttttcgaaacacgttgtcgataggaatcgagttgtacgcttcacctgtttcatcaaggatcagagttgagtgcgagtatagatgaggtttatgaacggccaagtaccgtaaagtacctcggtaataactgaacactgtactgtactgtacggtacttgtaaacgtccatcccgagtattattcaatagcaatgtacaatgacccgtatttgagacaataccgtcagacagggtacagttcggatccacaacgtattgacaagcacttgttctagcgatgcgagcttgacaaagcttcatcgggtcaatgggcccttttaaaccgttgagttcacacgaccgggtcagaagagcactaccgcagcaacacgagtgggggttggtggggggaggagtgtacaagacgataccttatgagcgtcaatggtattggtatctgagacgccaacagttactctagatgtcgatgtatctggttattgtcgtttcatggatcttctcgtttccgaggtcgtttctctctctatcgtgtgtctggggtcaagaaagagtcgtatcaagtacctcgtcatttttggttgaaacatttgttggaaaagtctttaattttagtgaaggttacttggataagacattttaataggcaacatgactcaacatctgctgtacctactgtaattggaatcatgccagtgagaactcatctgcctttgtattgtactcaagttcaacccactgttcaccgctgcagatgattactgctgagggtgttgaacttcggggctttcccatcgagattcggccggactctagcctgtcaatagcctgagctccctccgttcactctgaactacttcttcgggtctattttactacagtgcactactagccttcattctgtgggtctgatactccctccactattataagttagtatgtattaaataatggctagacgagtgcaatcacaagtggcgcgactgttgactcacaccctaccggcgtggcacactcctgcaacgcactcatgagcacacctccgtagaagcaatactatgctccatacactcgcacccgcaacccgcaggacactgacccagcccggtctgccaccactcggcagcacaggcggcatgggtaacgtgttcacagacgacacagaaaaagaaccggccctgcaccgtcactgaacagaaagcacactccttgttgttattcggattggctttgaaatgcacggttcgaggaggctgctgagaaacggtcttggaaaccacttgcgtgggctgcttagcgtacaaaccaatctgggcgcttttaatctctccaaacaacgagctatacgtgcgattattgaacttgagtacctccaggctctcgactgtcagtccccaggacgctagaatcgacgcatattgcattcggtagctttgaaacttgtcttctcgtgcagggtctagtagagaaactggagacgtgtcctggagagtagggaagaactcaatctgcatcttggggtagtctgcaggctcgtgttcggctagagacagaacgatggaagcttgtctatgcagaagaggtgtaaagagaccagaaaagtcgatattgtcatcagacgacggggtgtacgactggtcgcgtgtgaaaaaagcagaatcaacccgtgacaacgttcctcctgctacatcacgtgaagacggtcgagccattgacctcttccaccattcgggcgagccaaatgttgtgtttgaggtctgcgagccaaacggcgaaatgtcaatgacacgtgacccagaccgtttcttccgtttctcaggaatgtcccaagcctctgcgttgacaggagatttgagaaagtagttggtggagtgttcacctggcgggaaacccggagatctcacaaacgagagtgttccaggtgtttggggaacgttcaattcagactgttcctgctggtgcactgagctcatgacacaactcatatttgccagcatctgggtattgtgttgcttttcaaagtagtcaaacaagcgggtgaccagagcattacggccaaatggatggttaccccagtcacccagaataccgtcagagacattggaggtgatctggccaatattggggttgatgtggcccatgagattagacgtcagagaaggcagagcagcattacttccagatccaccacctccagcgcttccaccacctccaggagtgcaagtatccaatgttctggacatctcagttgggtccacaatgagttctagaatcctccaagcgtcggatgcctcttcatagccgtgtttttcggccacagcagcgttgtggcgacacaacaagtgcggaggaagacctaaaatctcgtatccctgtgctaaaatctttcgggatggaatcaggtttctcaagtcgagcaccttgataatatttgtcgacagcaacttgggactggtgccaaaggaccgctgcgtgtccgactctgcagaagaccgcactcgtctgttgagagcccggggtacaagagatgttcggaacttggcgtctctaggccagacggcgttttgtagcgaatcctgggaatcatccgagtctgaatctgagccatccatattgctgattttcatatttgtctcgattttccgctgagtgtgggctatatcgtcttttcgatgagtgaaaaaacacaccagcattcctccacgtgaccaaacagctccacagcccttggggataggcgtggagttgaatgagtttttccctaatcgtgccataggcatgattccatcatccgacgaagatgagccaaaaacatctgattcagcaccggaattacctccatcgtcagactcaaacacaatgttatcatgagatccatactcgtcatagtctgtcatctcagagccatcatcactgctggaatgttcttcatagagagcttcatcaatagacaagaactcgcccataagaaatcttaggcaagcctcgagacagaaccgaccatgatcagtgtagctgctactgattctattgagattggatttgatcagtttgatgtctgccttggtcaggtcctcattctcctcaatgaagtatgtgggaacatcataaggataatcgtggggaaacttgataatgattcgcaggaatgtcagcttgtccggctcattttcgtccagttgaccattaagagataccacaacttgacctgtagacacactgatcttctcaaatcgcactttcgggaaagttttccccacgcaggaaacttcttctccaagcgaggtcggcacaagacttcctccaatacccactccttcatcaaacgagccatagtgagaagcaaaggcagcagcaccaactcgaacacccgagagccatgacaaatgcatgtttcgcttgccctgagatgaccttaccttggtacgcattgtagttgccgccgggccgacaagacccatgtttcctccaaaactgccatgactaggagatacagacaatcccgaccgtcgccctccaatgccaactcctcccacagggaatgagtcggttcccacaggctcatgagtgtacgtgacgtatggagccccccttcgagtcaacttatatggtacaggcttctcacctcgcacaaagttgacacgactttcgagaccaggagtagaaggccagagacgcaggtcacgatctttggaccatgtgaccagctggaattctcggtcgtccaccttttggtcgagtccacctcttgctcgccacagaaactctcgaaccacatccccatggcctctgtaggtgtagacagggtccatattgaccttcccctccttgtctttgtagttcattatatgaaccgagttttcacctcctcgtagaggcatgatggcgcatcccgagccaaaaggagtgtgtcttgctttagaaactggaaatccacattcgacggtgatctcaggctccagaaaatacgagtagtttgtcctccaaccttcgctgggtccttggtatcctccctcggtattttgagcaaagttccagaacttgactgttccatctgtggaagcagtgaccaacttatagggctcacttctgtggaaatcaatgcaattgaccttgccctgatgtgcctggatccggaacattggtttggatcccattcgtttgtcccatatgtttagtcgccgtccatgggacgaagcgagcacgtttgaatttgttctgctccatttcacctgactggcgccggcaaaccagtcagcaaacgagcctgcgggtttctggggcgaccgcaggtcccacgtgtgcacaaaggtgtcgactgaacatgtggcgagcgactctggctcgaacgggtggaaattgatgtcggtgatagctctattgtggccatggagaaactgctgaagtgcctttttgctgtctcgtgcgaggttccataccatggctttttggttggatgtggagatgacccactcggccttggcggcgtgtggcgaccattgcacgtctgcgacttcccatgatgtgaggtgctggatccatcttggcggtgtgaaaggatcgtccaagtcgacaacgaagagtccggttcggctgggttagtatacaaaaatcaactggctgtaggacaagagtgaacaagatcctggttaatggtcatgtggtctatcgcgtcatcttaccagactcctggctgatgggtgtgatttgatgcccttggatcaatgtgagataccaatggttcatgtatctcttccaatccaaggaaacatatcatatcacatgtctgatcatgcgactgttgtttacgccacgtgctaagtcacatgacatcttctctgtcaatactcacctggccaggacaacgtctcgtcccgaaggactgatggacatggagccgacgctctcatcgactcggagcgacagcgggttgccaaacgtcggcgagttgaacacagaccgaggctggccctctttcgactgcattgctgaaaggtcgaacgggcggatgtggtgagatgttgatatatgcagatggaggtgtagattgagatgcaggacagtggagtttattttcagagtgggggaggagttggaactggtacttgggaggtaaagtaagttttgttgggtatttgaaggtaggggttagctattaagtaaaagtgtaagtaagtgatcagtatcggtaagacgactacgaatggtcgtttcaattggggggaatttgcactgggctgacattgatgtggtctgaatactggaaagcacatttcggaattggaatatatttagtgtaggtgacgatacaaactgatccgcgtcaggatggcaaaaggagacaccatctgaccctcttcttaatgtttttttttttcacaagatgacttttcatctcaacaaaagtcccaataaacccaactaattgatagtagccaaccacacaataccataccgcacttgtcacctgccggccacttatctgtcaattgtgaccccccacatacatcagtcacaccacatacagctaatgcaaccctccaacagtccatctattcagtccatgtttcaccgtcttatgttggttctttcaagctgaagaaacgtgtttcaaggtatccagtgaatgatcgccgactcgagagagagggtataacgagttacagaagcagtctcgagacgtatatttgaaatccttcaacatcgccaccaacaagccagtctcggcttaaacagaaaataaaacactcgacagttcataacacctcgatatacatccgttgtccgggatcatcctgtgaactcctcacgcagtatatgttgagcataccccagagtcgaaacagttcgaagtgggtacgttcatgtgccaccctagagactgtggtacgaccgcatagtattcacccaatgggcgggtaataatcctttgggatgatctgggggcgcggtatgagatcgacaagctgaccgtggcggcttcgagaacagccggtgacccaactgacgactccctctacagctgccacaacagcagtcacgatcacaacggccatggcggtcacaaaattagtcgtcaaagcggcgtactggaaattgacgaggactccaactcgtctctatcgtctcatccgccggccaaaacaaggaaaaactcgaaagagacagcagaagaatggcctaggggaaagcaccagaactaagatggacaaccgcaacacaattatgacttaaacctatcgattctagttttccgacatttcgacagggcacctaagaatggtacactttggaaaccatctctggcaagagtgtcaaaactatgtatagataggtcacgagtggagcagaattggctgtcgacagatccatgctgccaaaagctgtttccaaagaacttctagatgatcgctcgcgtagattccatcgacaaacatgttcgcaaagaatactcagcctggcttccaagttagaaggatcaaaggttgaaagacggactacgacagcaacggttagtacattcatactatgataaggtgttggacgaagatgcgggtctgacaagcagtttatggccgtactctgtgggagctgtggcagtgattgcgaaagccgattcgaagttatactctttgaattaccaccagggatggtttcgtcagtcgccgagcgaagccagcaaaggaggacaagatgctgaagcgaagctggcgaacaaaaaagacgacggggtcgtgtatttatattgtttgtaatatatctgtaatatagtggatggtggctttcctaccatctgaaaagactccagtggttatcttctaacgtatgtactgtagcctaggaaacatcgcccaaagcggcaaagtgaccttggccgtgctcttgaaccgtagctatatccatccactcatggtttctagtatcttttcccggttgtctagccttcttgactccagtgatcgcatcaaggctctatacagtagtacatgctgttcctggtctaaatcatgttaatcgtaagatacctatcgatactggttccagaactggttctggttggcaccctgggggggaggtggaggattctggccatattgctgatgatggggcggctgtccgtactgttgatgctggggaggctgctgcataaacggagagttggggccatatactgaaggatcatacgtgctaggctggccatagttatcaccggtatgttgctggggcttgggaggcaaggtgggggccccaccagaagtaggagctgcagaagagctgccactgccaaaagaaagacgtccaagctgagactgaagctcgttggtggtattgctctgaatggcagacaagatggacttgccctcctgtcgtctagcgttgacaaactgagtggccgacacattcaccttgtctgccatgttttgcaggtctctgtagaactcaagacccttgtctaatccagtcttgacctgtttccacgactcaaaggcctttcggaatcgctcaacaatcacgtgactgtgatccagagcccgttttcggtctgtcaccttgtttttgaccacggggtcacgtgtaatcttctcccagctgtcggccaagtccttaatcagcagcgcctgggtgttgatagtggcagtcaggcgctgttggtaaggctggaacttctccagctcctgttcaaaaataagattgtcgtctgctcccttggagttgactagaacgccagagatatcgtctctgtgaaccttgtccttgaactcgtagaaaatagcctgacggtccttttgacagttttgcagctttctgaaagaagtttcgcacgaaggaagcaacttgtcaagagtagaagaggcagcaggatcccgagaagcggctccctgagagaaatccaaatcaataagactttcagatggtccagaagaagacttggaagaagacgaatcggcatcaaacaacttttcaagctcagggttgttgattccacgtgacaaaagctcaatatcaggcttgacaccgtcgtattgagcctgcagcttctcgtcactggcaccggcagccaccagagactcctgcacacgtcgaatgtcgctcaacagggacgcattgacctgtgcagagggtgcctgtgtccatccgtccttgtagtagtccttcattttggtggattccgtctcttcagaagcaatcagagcctgggagtctctaatctgggtcagaatctgatccctggaagtcttgagaggactgagatcgagagtcttcacttcagaagcatatccaagaacaacagcaggcacctgagctgaagaaccagagtctctaccgctctgaagatcctttttgagagcatacaactcgccaggaagtcccatgtactccagcgcagagttgagtttctggtcagcaacctcaattcgttctccttcacttcgcaaaagagaggccttttcttcactgtaaacagaagtctgctgcagaacgtgcatgggtaccagtcgggtaaacaggtcgcggccgaccactcgcacgtgatcttcttctttatacatgtcttgaagaggagtagcagtgacgacttccttgggttccacagctcccaaagtggcgggagcaggcaccagcgagtggtagatgagatcattatcgtgttccgaagacttgagagtgcttcgagcaagatcaagagcggtggaaacaagatctcggtaccacttgttgaagtccttcttgttggctccattgggcaacggcaacattgaagcctcgttaaactcattgatggacttttgaatgtatccgatactctcgccaaacttttgtgtggacggtttgttctgaagagacttggcatacagaagcgaaccaagtgcagtaaagtacttgtttttgccctggcactccaacggccagtttttgtcgccccatttctgttcctcttgaatcgctgtgaaggactcgaacgcagccttatacagagcccccactccggcacacagcttggcggtcagagcagacacctttccggcctgctcctggttcacgtcagtcagcacagacacacttttggcaatgctatcctgacaaaacatctcctgagcctgtgccagcatgagcttgttgaaggcacgaaccacatcctggccaatgtcgggcaaaggggcatgtagaaacttgtcggcaatgaaggcaaagacaccagcagcgttctggaacgcatggaaggacgccttggggtcacatgagtcgtcacgtgacatctcctcgcccatgcagctcagaatcgctcccaattggtacagcacgttggccttctcgaatgagatggagtgctgggtcaccttctcctgagacagtgagtcggaccaggtgaagtccggtttcatccccgactcggccgcgttgatccggcgctccagtgagtccaattgagcgaaataccggaacaaaatatctcgtcccgtggcatctcgtcctgctccccgtatgtcctgtcgtagtcgttggaacgacgagatttcctcccgaaactgctcggcgtagtccggaccgtatgacgacgcaatgtatctgtggatggcacgtgaccagtccgtgctttcggtcgttttcagcgccagagggatcatcttatgagtcttgtgttgtagtcaaatgtcgatacttgtacgagttcttgcacgattgtagtcgacatgcgtaaggctgtaactggaataccccgtttgagcttattttccaggagttggaggagcatagattatgactgtggagagggatggtgatagctggcagggttagggctattttaagaggatgggggttgatttgcaactcttttaatcagttcaaaccgctcaatttggtcgtctaatactcagagagtccccacatgtggtttgctgtggtggcaaacatgtggaaaacttaactaacgaccgatttttttaattgggtttggtggggatgatacttgagattcaacgtgggccaaacccctcaagatagatagagataaggaggagaagtggtgttttttgggtaaatataatctgtgatatgagctgtgtgaaacacctagttccatgatctcgacattaccgtttactacttccctcgtatagtacacacaacggtggtaaaattgctccagtgtcaggctgcagtatcataaagttccccacatgatgcgatatgcttggacttttgtcaccacccaccacccagacccacagagcagagaacggcaccaacagcaccagagagtccaagccaagagaacccctacgaccctcgacatctatttatactaacccattgctcagtttgacagcaacccaaccacgcgaaccaccgcgcaacaccatatcaaatccaggtcacctcagaagaatggacctaatcacgaaagaatccggccagctgggcaagaatgcgtctctacaggcttgtgaggactcggtggacgctctgctcgagtttctggagcaggcaaaggccaatgtcactgacaaacaatacatggcccaagttcacaccatgtacaccagccaggtggctcctcagatcatccagacacccaacgatgtgcacaaggccatatcgcggtatggaaaggcactggaccgaacgttcaagctcaacgtcaactcggcagcgtcgtcaattgtgcagattgcgtctgataacgacgacagcaaggaagccgtggagtcacgtgaggaactgaaccgggccgtggcggtgcatttgctgcggctgggcgagtttgacaccgccaacatctttcttggtgaaagtgccaccaaattgcctccattgttggtggagcagttcgagctgctgtatgacattctcagatccatgggagaacgcaatctgcaaccggctatcgattgggcgtcgacgcaccagcgatttctggactgccgaggctcagatctcgaattccagctgcgagagctccagtttaagatgctcttgagtcagagagatacaagtgcagcccttgcatacgcacgtacacatttccaaaggtaccagagacactatctcaaggagatatcgcagttagtcaccagcattctttacagttacactggaaattcgccatatgaaaagacaggaggcgaagtatcaggagacgatcatgctgtggctctcaaaactgttcagcagacgctgattaaggagttttgcacgctgctgggtctgtcgtccgaatcgccgttggtccaggcagtgtcttcgggaactgtggctcttcctattctcgccaaaatgggcggtatcatgaaaaccaaacgaaccgaatggacctcgtcgaacgagctgcctgtggagattgatctgccaccagagttccaatttcactcggtgtttgtctgtcctgtgagtaaggagcagactacggatagcaaccctccgttgatgttaccgtgtggacatattctcgcccatgatacgctcaaggctatgagcaaggacagtgaccggtaccggttcaagtgccattactgtcctgaagagactacatttcctcacacgagaagggtctacttttaggctcggagcggttggaccttgtaagtggatggccattctggtagtgtcctcccaaggtgtacattctgttccatcgtgacatgaccactcgacgttgcatcacggccatgccatctttgacatgctccgactattcagtaggaccaagaccgtggttctactgtaccccacaagtgtagtctagccactttaggctgacgacttgctctaggactccgccgttgcaattgtccagtgtctgaactcccattatttaacacgatattttcaaaaattaacaacgtgcccacgcaaatgtatctgtcttcgctgatctttggtttttttccctttttttcttcataattgttctttcatccactcagatcagataattactgatccgaactcacccaccaaattaaactcggagcactgcaagaggttgaggtagaagtgagactgcgcaatgttgaggcatatatgtgtgatgtgtggatggcggggttctgattggtcggcttgcagtgtctataattagtacaagtagacaccgtgttatcttggtcttttttctgctctttttcccctcccaaacgacgccccgtagttttgttcaacacttgtgcctacagtacacagcttaaatcacgctatcagatgcgagataagcggtaggagagggagcttgaagaaggagtgctgagaggggacagtcgagaagcaaacaagttgaaaagcaaacaagctgagaaacagagaagacgagaagcagacaagtcgagtagattctgattactaagcactagttatattggtctgccggcccctgtttttccactcccttatggtatacatcgggctgtcatcttgtgccgtcctcttgcgccgtcttcttgcatactcactcgccctcgccttggctgttgactttttacctcatgggctttatgcggagtccgaggcgcatgaaagggcactacgctaaaaacgggtggtagagagccagagaaaaggagacaacccaaaagatggactcgggggccaaaaaaggcggggaaaggggccgattcaggggtcacgtgaccggttaaaccctcgtccagggcttcttctttccatctaggcgggcatggggctcgttgtagagtcctcttgtcctctccataaccgctgccgttcacgtcgtcatctcccaattaagactgcagttgcccagtttgggaatagggtttcagcccttgacgaggcgagaggagttgagaggtgatggaggccgtttggagccattgcgcaggatgtaaccaagcagatgggtgaatgttgcggtttaccttgttataatgtgtttttattggccattgctgctggtcagccttctttctaggctggatcaatagattaactttttacgccccgataagcaacatactgtaggcttacagcagctaaattaccagtagtttccccccaaagtacatacgccacccaacctgtctttttgtcctcttcctcctcttcatcacaaccacacaccgcgacgatgaagttctcaattgccactctgggactggcagcgtccgccgctctggccgccaaccctctcttcaaggatatccaaaatgtgcttggaggcgacttctccaagaagctcggaaacgtggccgacaagctggccgatggcgctcgaaagaccaccaccgactccgccaactggctctacaccgccaccaacaaggcccagttccccaactacgctctgcgggccaaggacccctcttctctgggtctggacaaggtcaagcagtactccggctacctcgacgttgaagacgaggacaagcacttcttctactggttcttcgagtcccgaaacgaccccaagaacgaccccattgttctgtggctcaacggcggccccggctgctcttctctgaccggcctgttcttcgagctgggccctgcctctatcggcgaggacctcaagcccatccacaacccccactcgtggaactccaacgcctccgtcattttcctggaccagcctgtcaacgtcggctactcctactcttccggctctgtctccgacactgtctctgccggccgagacgtctacgctttcctgtcgcttttcttccagcagttccccgagtacaacaagggccaggagttccacattgccggcgagtcgtacgccggtcactacattcccgtgttcgcctctgagatccagtcccatgatgaccgaggattcaacctcacctctattctcatcggtaacggcctcactgaccctctccgacagtacgacgagtacgagcccatggcctgcggtaagggtggtgctcctcccgttctcgatgagcctacttgcgagaacatgcgtgactctcaggcccgatgcaacggcctgatcaacgcctgctacaacaccgagtctgtgtggacctgtctccctgccgccacctactgtaacaacgccatgcttggtccctaccaggccaccggtctcaatgtctacgacatccgaaaggagtgcgactccggtacttctctctgttacaaggacctcgagtacattgacaagtacctcaaccagcccgaggtgatggaggctgtcggagcccaggtttccgagtacgagggctgcaactttgacatcaaccgaaacttccagtttgccggtgattggatgaagccctactacaccgccgtccccgctctactcgaggagggcatccccaccctcatctacgccggagacaaggacttcatctgcaactggctcggaaacaagcgatggaccgacgagctcgagtggttcggcaaggagaagtacgagcccaaggagctgtccgactgggtcgtcgacggcaagaaggccggccaggtcaagaactacaagcactttaccttcctgcgggtctacgaggccggccatatggttccttacgaccagcccaagaactctctggagatgctcaactcttggttggctaaggattactcttacggatccaagtaagatgtcggtaatggacagtttcgtgagaggctggaccgacaacttgtagccatcagtagcttagcacgagctattttattagctagattattattgaatatatatgccattgaatgaagagaatctgtagatgagccgtaggtgtgctgtgggacgtgtatggaccggtgatataggaggaatggttcgtttatgctacagtagccagatgtatcaggaaggatctcatatcaaaaggtccttcgcatatcatcacagactgaacaatccacagcacacgtagccttcacacaatcttctatgaagtggtgttattgttagtactgggtttcacttgatcgatagggcaagttgactaagttaacggtctcacttggtcctttcctagacgccagaaacagatcaagaacactacggcaaagccaactcctccgcaggcaattcctacaaagggccagatgagatcagggtccttgagagcaggagtgatggcggtcttgatggcagtagagacggctgacatggacagcagcagcgacatgaccacggattcgagaccagcaggagacagggagtaagccagctcgtaagaggtgatcactgcaaagatctcagagacagcagccaaaaagtagggaaccacctgccaccagatggtgatatgagacaccccctcgggacactctgtggcataatatccacaaggagacgtttcgtaaacacgccattgaatgattgcaccagccccggaagaggcagcagccagcatgaagcccagaaacatgcggaaagaggctcggaagttgattttcagccgtcggagcgtggggtagatgatataatcgacaatagggatgcatacaatgatggtaatgggattgaagttgttgaggagatcgttgggcacgccattggtgagcatggaagcaccctgagaattgaacaaggctccaataccctcgtcgttgatccagtacatggggaagaagaggaagaatctgcaggccttaagagtggaattgacgtcaaagacaaattcctcggagtaggtgggtggcttgcgcataattctttgatacaagactccgtaaaagccactgagaacagaacttctgctgggagggaccttgtagacatcctttcgaacgtaccaaagaagaggaggcaagagaaagtagaggatggtggggatgagaaaggcgagccagaaaccaacccttttctcagagtaggctgtagcaatacccagagtgaccccaatgttgatgccccaatagtagaccagggtcattctttgcagagtagcatctctgtcaatgactacttcttcgccagaaggcagcttctttacccaatttgccttttctcggtactggtccagcagcagaggtagaatgttgggtttgaacagaccagttccgatagcaaagaccaacaggccgaccatgaagacaccgaaagacgcgttggtgtgttcgataataccggggaagccagcaatcacaattatcacgtgacccactccacacacaatggtgccggcccagatggtgttgaatcgtccgtatcgggcgtcggcaagccaggctccccagagaggagccacgtaggagagaaactgcaaaacgagagtgacgacggtggcaatttggagacccttccctagagctccgggagtcagctgagtgcctactggtgaagctccccatccgttccctccctcaggaaagggaaactggacgtagtttgagatgacattgactaggccgtagtaggagccacgttcggcaaactcgacaattgacaagaggtaggtcatttttccaaccggtccagcaatgtgtctgagatccttgtcggaatctgtggcggttctgagaccctcagggttatgttcgtccgtgtaggcaccccattcggagtacacctcttggactgagcagctgtcggtgacttcgacgatgatgtcttcgcctttttctttggtcaggatagatgcaggtcgagaaggagttggggttcgagtagagtccatactggctcggactctctctagagccaggtgtttggacatgttgacagtggttgtaggagatgttgatgaagttgatgatgtaacagatcagagaaaggcacatacttataccatgtacgtctggtgcacgtagatgaagactcgtatgactggcacgcggttatctcggtgtgtggggaatatgtagatgtttgtttgcggagtcgcaacaagctgaggggtgggcaattttggatcgaactgcattgttatgatcgtggaaaagaggggaatcgaccaaagtaggtaactgtagcatcatcatagagctattttcaatcgatgggtttatctcacacgaagagatctgcatttctcatgtcggcggctaagcatgtgcagaggaatatgcaagagtccacatgttggagcatgagctgagttgaagagagatgttgttggtatcactgtggtcgttggggacgggagatttcatttggtttgtttgttttctctgtctttttttcagcgagctctggaggcactttttcgctccagatcagcttggattagattaggttgagtgaacggtgagaatgcagacggagtggagcgagagcaccatgtacgatacgaagtcgagtggggttttcgtggtggaatgatggggtcaaacagtgactttgggtcagattctttctgcgcgaaaactgccgccggaggccatcaacgggcatttacgggcttaagcgggggtcatcaacggaataggtatcacaactataacaccacagctgttctcggagatggcttcccgacggttcagggaatgcacgagagccggtacagtacttgttgtatgccggtacaagtacttgttgttttccggtacaagtacttgtttgtatttcgcattactgcttctgccctcaatgagtcaactggaagtgtttgagttccagttgtgcaggttggaggtatgtactgtactgtaccatgatctcgccccaacgatatagtactgtgaacttttccggagctgataatagaaaaagtgaatggccttctaccaacgaatgtcatcctacccagtctgttgcgtatgctgtacttgtacccgtatagtactgtaccagcacttgtatgtacaagtatacactggcattgtccatagtagaagtatgtactgtacctcatttctcccctaccaattaacccaaaataagaatttacctctgagataaagatgcgaccatgccgtatcgctcaccaggagctgtcatacgagacatgtcatgatgatgtggaaggcttttgattatcaacgtccaatttcgtcacctcttctggttaaatatttccatcatggatcgtctcaccatccagtcggcttgtatcgtctcattcttacttgtcctcgtgctggtgctagagctttctcattgtcctttcccccctgtgactggctggctgataagcttgaagctacgtaactgtagcggagaacgagtatgatgttaagacgagtacgagggtaagacgagtacgagggtaagacgaatacgtactagtaggttgatatctggccgcatttgattacggagacgaaaaactatcatcctggggttctttttcgggcatcacgtgatctcatttccctttgtcgttgctctttaatgttcattttcattcgttggtgtgccgttgcaactcatcatcgtagtttttcgccaagtgaactacagtgtacatatgtatgtacatacatacttcccgcgcgtataatatagcagtcgtagtcggaccgcaatgtgctgccgctactgtgctgtgactactgtaccatagatcttggttgtcttctagccatcggtaattacttgtatttgtatacgtactcgtacctacacgagactcacaatgaccgagtaggagcggctaacgtggatccaccccacccaaggaaccccgcctgcaggccgtacctagaaagtgcactccatgcatccagccccacagttgccgcaattgccagtgtattgccactgccactgccactgttcgatattttggtgctgtacgataccggggacgaccatatctcgtttttgttctatcgagtgccatagatagttcagtccagactcagtccagactcagtccagactcatgaagggctgtgcagatttagattcctgacagtcacagttttggaaagagacagaattttacgtcattgtgggtggctacttgtaggagcaatggaaattcgttgtatcatatgaagaaaaagcagctcacaggtagacaatgtggcattcctgcttttggttggtgtttgtcatgctgtttatggtccgttatccactcttaggagtccacgatctccaaccacttaactagtcgcggaataccaagatccgcggaaactccaaaacggaacatatgaaaggacgtataactgtggaaggaaggacaccacctgaaatctgaaaataccacaagaaactacagatttcacattacagttcgacaccttttctaattaaaatacttctttcaagcctttcaaatcgccgtcgcttttatttcgcaacttttggtctgagtagacagtaaaaccgtccaacaaagttcgccagcaccgtgggcccgtttagcttaggggtagagcgttgcacttgtattttcagaatgtactggaatgcaaaggtcactggttcgattccagtatcgggcagttctttttgccccgtcagcccctgacgttccgtcatgcacattctgcttcatgtgtgccggttttcagcgtgccactacctatgttctgccccttacatccacagctgtaatacgactgaactctgtctgtctactgtgcgatattgtaccataactcacagtgcaagttagccgttagttttagctcttgtatgcactgtggcgtaaggttgcgcggtacagtaactggagctgagtaaaaaaaagcacatagatagagtagaagacggggcaggtgttgtgatagacagcggatgaaaagatatttcgccagttgggtgtgcacatacggaaaagtgtcttgcagattgcgtttgctgttgaccactcaggatctacgggcttcgtttccgtgtcccgtctccgttcgataaagttcactgcctggtatcaatcaatctcaccttgcacaactctgaagagcacaacattttacgatatctcgagtgttttcaccgagcgggcaaaaacgggagtactagatagcgagaactagagacggcagtgcccagttgagaagcaccgacgacccatcttcaaaaaaacacaaaaaacagcaagtgaaacctctttcgacagcaaccaaaaccgcacccttcaccactctcatggacgacgtaccgttaatagtgggactgacctcgggcctgggaacgctgattctcgggctcattctcatcacagtgtggctgaccatctcctcgagccgatcgtccggccgtatcagactgggaggctctgctccgggatcctacgacgatgaacaacagtttctacgggacgaggtcgaggccatcgaggccatggacgaacagcaacgcgaggcctactttgccgccaaggccttcatccagaccaaccccccaaacagcgcccagagcgagatatctctcggccagtacatgaccatccaggagaagggcgtggcagcctgggagttccagatggacctgtttgccaacacgagcagcgcagccctcagcaacgccgcccagagcgcccacattacctgctttgtggaaaaccgcacggagctgcagtttctgggaggtgtcatcaaccgacagaccgactccgacatcacatacacgtcgccacggtcggtccagaccaacctgccgctccccaaacaaaatgaaacctactactgggaggtcaagatgtatgacaagcccgtcgacaccaccgtggccgtgggactgtgcaccaaaccataccctctgtctcagctcccgggacagcaccggtactctgtgggcttcgagtccaccggccacaagcgcaacaaccaacccttcaacgacgtgcccaagtacggactacccttcaaccaaggcgatgttgttggcgtgggttaccgaccccgaagtggcaccatcttcttcacccgcaatggaaaaagactcgaagaggtggtccacggcatgcggctcaacctcttccccaccgtgggcgctaccggaccttgtcaactgcatgttaatttcggacagtctggatttgtgttcatcgaggccaatgtcaaaaagtggggtttggcccccgtccagggcaacctggcccctccgcctccctacggccgacaccagcaaaactcgctgcttctggagtcggaagaacccgaggccgaggttgacgaacccgaatcccctcctccttctttcgagaggactctgaccagcacctccaccgcttctctgggagacctccaatgcgagtaccccgaagaaagcatcaatctggccaaactgaccccccaacaggggtccgtggagaacttgccccgagcttccgagactgcgaccaacaaccagcctactagctctgttacagtggaagatgtcactgatgagaccacccctggagatgcagttagcgtctcttcctctacgtccgacggccaaacagtcctggacatgttggaggaagctcagtctgtcatcatcgatcctccccagcggtctcttaacacgtcaccacctcctagttataagagcgacagtgactcaagttgagacagcattccactgactatttaatgtacatttatttattgaggcgaatctaagaacggaaacgaagaaatgagtccacaacaacctttgaaagaagggccgtaagtcatgagtggtgtgtctacaatgtagtgtgtatgtaactaaatacacatgtttgtaactactacagaatcattctggccattgcattataaagaatcatgaaattatgtggttatacaagagctcagtacccgcctgattcctgtgtattgtacttcgtagctaagtccaagcgtaaggagactttgctctcagtttctctccatgaatataaaagacgaaaggaataggaatcatgatgcaactgacaaaccccagcaaactggtggcccaatggtagctccagttgtcaaacatttgtcgtgcaaacagagggaaggcgcaggccatggccgatcgtacaaaggcgttggcagccatcgctgaagcagcgtagactcgataaccgtctacgaggaacccaaaagtgccagcaaacacaagaacgatgcctgctccaaaaaatccggagccgatcatgggaacaatccagtgaatggaaggataacatgtccatccgaaccaaaagagaccaatgggacacaggaagcaaccaatcatcatggggatgagtttcagctcgggcgctcctccgggttttcccttggcgatctccttgtcgttgaacctcttggtcaggtatctcattaagggaatggatccgtaagtcgctgtcagttggccgactcctagaggcagaaacgacatgcccttgaattggagctggaagttgtagatgttaccaaacaccagaggaaagaccacaaagaagccgtacacaatggccagtagaaatccagagtagacacagactagcagtaccattggatctcgactcagaagtccaaacggtcgctgacagttggtcatgacactttttcccagagactgagtcttcttagtctccatcagagcacaggtgtagtagactggggtcttttcgttgatggtaactggagcactggggttcttttctgggtcgctggagaagacagaaaccaaatgatctttcaagttcttctcccgttcacctctcagtcttctgacttttcgttcagtgagcacaggagcataggtttccttggagaacaggatgacaatggcaaaaagcactccactccagatcatcattacccagaaggcccatctccactttgtgttttgaacaatgaatcctgaaatcagagggccgattactggaccaaaaaagggggagattgagaaggttgacattgctagcaccagcatatcgccctcggtcttcttgtcgaagatgtcggtgatagtacctccagagacagcggcaaacgacgagctgaaaaaggcgctgagaaaccgtccaaccagcattgtctggatgttaggtgctagacacactggcaactggaagataacgtaaagaaacagaccagcaatgtagatgggtcttcgtccatagtactcagacaggggtgcaaacaacatgggtccggaacctagacccagaatgaacagggaaatacctagagaagccaccacttttccacaatgaagttctttcatgatgggtcctgtagcgttaccaaacgcactggaattggctgtgatttggaggaacgttgcacacacaatgcctgctagtagccacttgtgagccaagctgagttgtgtagagatattctcagggtcatcaggttcaagagtcaccatgatgacttcgggtcggcgatctccatcttgggtgtcactcagagatctggggccatcagaaaccgttggtggagttttgatttcagcaacattcacttcgggagaactattcgcagtagagtgctcgaatgaacttgctgtggtagaaaccacctcgtgatgacttgttgtaggggtgtccatgattgttttgcctgagttgcacggctacaaagtccattggtttatataacgatccgaatcaatgtgtgatagagtcacgcgctgctcccctcatctctccccgcttatctagcactgcatactgtgactagcaggatatgtagtatggtgatatcagtggggatggaggtagggacagagaagtgggagcatctttggggtacctagagttgatattttcaaagtcgattgaccttcaaatgtgctataacgtagttacctactgcccatggttgtcacaggaagaatcagccacctccaattccttggtatactaccccacaaaccaaactacaagtagcagttagatcaactcccagaccttagataaggcaatgtgaggcacgtagaccccaagaaagatagtagcagagcaatccacgtgatcctgctgattctcacatggttttatgggcatgacgctctcgagcctacctgatgttggtgatgtgaacttgcaggtccagattacaagacttcagttctcactttagaggtattggacttctcataacataattaacatatatttaacactgaaacaaattgaccagctctctagacagcaccactcaggtctacaagtagtagtaccggtagtacttgtagccttatctgtttcaagttcccctcctcgtcaacttagtattctggacaagatagaggtatgaaggaggggggaaagagacccgctcggtccagaaggtggttattttgaaggcatggactcctcactttaaatggatcaatatatcagggcttttgagctattttcgagttatcgccataagtcagggctttcctcggaacttaaaatgccttggtccagatggatagcggagtaccaagccgccataaggactagtggttggacgaaaaaagtcgaagggtatattactgcaagaatctgaatgtatttcttgtttttcaggcactcacaaatctctacctatcctcattgcagcctccagacactcctccatgctctgtttagatctatgaaaaatggtgcgttatcttagcgagatccccgttacccctcaagatacaatagaaccaatatagcggcaggggatccgggagctccgagaggtgcggcttgttaaaaccgcgactatcatgtcgagatcaagtctaaggaatgactatgttttctggaacaggctggtgttcgcgcacgtaatattacagtactgtatgtaaagactgtactgttgagtgattgtctacatgtagagatactgtagtttactagtagtacgactggtgagctatgaaagttatgtctgtatcactgcagtcttcaggtccacagcctcgtgctacagtacgtacttgtgcttgtacttgttcaggttcgcactgcttttccttctactcctatccaaaaatcaactctgacgagattccctatacccaaccaaactaagggctccaaaagtgattcaacaacaccaagatcaaaacacagccaaaaggcaccatgaagcaaaaaggaagctcgcagtgtcttacacgcaccgtatttgtacaagtacaagtacgcgaaagtcacattatcattgctcttactcgcataacccttctactcaagctcctctagtattgggagttcctcaactcatcccatcaaaccaatatattatctactttcgctttttgcccttctttttgccgtccttcttctccttcttttcctgggcgacctccttcggagcttcgggcgcaggagtctcttctttctcaacgtactcggtgttgctcatggtcagagcaaagcccttttctcgcacaacggcggtggatccgggggcgagaggcgcaggagcactagaatcctccatattgacgtcctcggtctgattgtccagcttggcctttttgtttgttcgcttcttcttggacaccttggtgatctccactcctctaggacccagggcactaagcagccgattcagctgcttggcacgagtgatcttgattcggaaacacacgccggagacgggatcaaaggttttggcgtacaaaatgggctgggcagcagcagaatcctcgtcctcctcagcctcgggagtggcttctcgtgtcgggtcgacttttcgcacctggtgtttgtaggtaagcgacagccgggtggtgtcgggacgcgcctccagaatcgaggcacttcgctggataaacgtgtccagatcgtggattctaggcatgttgtgtgtttctggcagaagtgtcacaacagcggtgatgatgatgtatctgcatgctggaatttagtcacgtgagttgggaggtaggacaagtacatatggtgctcgtaggagcaggcaggagctgcaattcagaggacaagttgagctgcgaaacagggataaaatagtgatcacgtgaccgtcgactggcgttggctgccgttgaaaagcaatttggcaagttcacctacattttcacctattctttcttccacccgctccatgtttgattgtgggtaagggtagagctacagtaggggaaaacctcccaactcggtttttgacctttaccacacacggcgagatggatgtaccctttgtactgtatgtactgtacgtacaagtatgcctgtagttttacattaagaaacgccacaatagagctgaccaaagcgccaatttggtgtggaccggttttaaaaaggttgggctcagccgaaacaggtatggcccgactggacgcccagaggggccactctttccgcagacaggtcacagtcggggccaaggagtaatttaccggtggccaattgtatggtatgtgccctttggtacaaaagtaggtctggtaggtctacaagtatcggtggtatgagtacattcttgtatgtacatactgttactttacaattgtattgtcgcgtagcgaatacgagttccagaatccgtcttgggtgcaacttggcaaactctcagtacttatgcaacgcggcccattgggggttatttgaggtaattacgtgcgaacggacaaactaccgtactaatatacttgtagcaccagtaatggtaaggaagcccaaagtcaaatgggcgttgtgctcatagtaactgaacgggtgctccgtctatgcatttcctatagctaggatatacttgtgctccttcaagtattccacagtactcctactactagtattggcacgtatgatcgtaagggaaagaagaggggaacatgtatggccgagcaagtgtagcagaaagcatgtccgtggcaagtgaaccagatacccttggcaacatgttagcgtctcagttggaaccgcctccatacaggtgctgactgactccatgcatgcaccttgtccctcctcccagcaatctaaaaccaggaggacatgcataatctttcgcaggaccagcaatttgatacaagaaagacacactatcataaccgacttttcactagagcggatccacccagcttaatagacgctccttcaccacactcgccccacacatgactgccccagaaaccatctcgcgctgggaaacacagctgtccgcctggtacaccaccaccagcgaggctctggcccaggcggcccaagccaagcacaacctggccattttgagcgccaggcgccagctggacggctcgtggctccccgagggcgtcaccgatgtcgacagctaccgatcccagcaactgcagcacgtgcagtacctcggatcagacgtgaccacctggatctaccacgacattggcaaggagctggccaacaagctgctggagatcaagagcccagaggacgagaccaaggccacggaaatgctcaaccagacgctgctgctgctgcaaaaacgtcacgcgcaggaactgggcaaactgcggaccgacgaggccacccagcagattctgctgcccctcaccaaagacgagaaacggcctgcaacccagactgatttcttcaaaatgatgaaggagatggagactggccaagagggaggagaacgagaccaccggcccttcaccagagatcaggtcaacatctactacaacgactggctggagaaagaaaaagaagagaaggaaaagaaggacaaggacaagaattagaggtcgcagtacaaaccgacataaaagggacacggacaactccaatacagaaggaaattcatataataatgcattataaaacgtcaccaaagtcgatacttgaacagaaagcgtggttgtactgcaaataataatatgcactctgataacaagtacaaaaagtgtacgacgatagcgccatccactaattaatttagtgtatattattacagtattgtaaccgatagccagaagtataaagtgtaatgcagtagtaatttcatatggcaattacagtagctacttatatatataagtatatgggtgttgatggtgatgggggggctaacccgattggatgtaaatatacacagcactcgcacgatattcgaacggtactcaaacagcacttgaataatctatttgtgcatgtagctaaaggagccgatatctcctcttccctcctaaccaagaagtccctcctcctcttctcctcccttgcccttcttctttcgcgacgactcaccctgctgatcgtcctcatcctcgtcgtctagagcaaacagagtggcatcatctgtagcctcaatctcgggcgatttcgagctggaggctccctccttgtccttcttctggtacactcccgatagagtggccttggtgtcggatcgggtgagatccacatcatcgggcatggagtcaatggatgttcggttatggtctccaaaagggttttcctgggggatgccgccgacgtttcgctcctcgtcgtcgtcttcgtcgtcggagccggccagagatccaatctcgaactcctgggcgtcgttctcatcctgggccagctcagtggacatggcaaaccgcttgttgttggcggtgggtcgccagataaaggcaatgagcaaaaagtcaatgaagtagatgacgttcacccagccgtcaaataggaaccatcggtatttccactcggaaacaatagtgtcggtcatggagccggaggtcatgatcagagcattgaagaagaagaagccgcagatgacaatgacggaaccaagcagaatccaccacaagtttcggtacatctgcgccttgacgtgctgctttcgctccaccagatactttgtggtggcggttagagaagacagaatccaaatgtagaaagtggtcagagtgatggacagggggatgatgaggaacagaatcacgttggacgcatccacggggtccatcagatacagggcaatggtaaagatgagggtgaagacgaaatgaatgcctcccagagcctggcacttccacatgagattgcccagagtgggcttgacaacaccgtatccaagacagacaatgagcagcaggaagaaggtgaaggcatttcgcatcgaattgagaatcgagacaatgaccaggaaggccttggagccgggagagtctccggtctcgttgacaatgtcgtaataagaccacacaaacataacctcaaccaccaggaaaccaaagataccggtgatgtagttctggacaggcaaaacgtcctgtctgtgttgccagtaggagaacatccacagcagaaaggccaccaggtaacagattgacagaatgccgtagaaggggtgcttggggatctgactgccagggaggtatccgtatgcgctctgaatgaaaatcttacccttgtaattgtcgtcgttcgagaaggtggcgatacagtagtagccagttttggacacgtcgtatctgtaggtctctggttctcgcaggtttacccgatgcgtctcgatcttggcgtatgtctccacctctccctccttggggataatatatgtaccctcctgttccttggtacacaggttcgagtcgatggcttgctggtcacaaacgtacttcttgatacctgtgtcgccggggatgtcggagcccatcttgtcgacatctcggtactcgaagatggcgaacgccagccagtcgtctgtgtctagtttttcgggggtgaactcgatgtaaacgtcgtgctttcctccccagtcctctttgttgtagatacccgagcattcctggcgggagtttttgttctgtgttagtcttagtcaggttggaaagctgtaaccggagataactccaagatagatgtggaaggcgtgattaagcatgtcttcgtgcacggcgccccaaaagagacaccaaaaaaattctcgggaagcccccgagcaattgatttcgagcggagatgctttttgcccaaccttcgtgtacaatatcgaagccaacgtgtccgcccatagcccccagaccaagtagctcatggcgggcggtaggtaccaggtgcctattctactcacaatcttcaaaacctcggcacttgctcctagagcaagaaaggccagcgccaaattgacacacttcattttcgctgacgtgagtgtgtgtgtttgcgtcgtgtgtgtggtgtgtggtgtgctgtggtgaactggaaagctgggggtacgtatatccgaaccatgcagatgcgctgttaaactaaggttgactggtgtgccaagcagctcataacctgtcgagtcgtggcacagctatggggcgcttggcggtgcagaaatgggccaatcagataactggatcggccagattgcgaaatgaatagtcgccactggctacagtgcccgcagtccactttgagcgattaagttagataacgcatcattcgtgcaccagcagatcaaatggtgatggaacggtgggataagccgcgtcccagaggagcctggaacagatcatgccgagtcctggggtggaactgttagtctacaggcagaatacctccaaaatattaccggaaatttcccattgctgatctcacctgggatttctgttctgtaggtctgtcgtcatatgctgactggaaagttggctgcaaggttgggaggagtggtggtcaaagagaaggagtagcacttgggagtttggttgggaatagttggatatataatgttgcggaggtccctaatttggttttcctggcacattaatgcaataatgaagcggccgtttaatggaaagtaccgatgtatctaacaaatatataattatatataaattattaccaacatttatggctagtatggcgagatgtcggcgagtaaatgttcttcacccaagtacagtcaattggctatgtcgttgaaggtcacttgggttgagggtttgcccatcttttagatgcaacattggcatattacacccgcatcaaatattggtcgtaaatcattaataaattacatgagtatggttaaagatcccattcgctcttgccctggggcataagcgagttctcaataagatccaccttgatatcggagcagatgaagcacttttcggagatgacatcatcgagaacctcctccagctccttcttacaggacactcctcgagactggagctcgctgatccgcttcttgagcttgtaagaagcattcttgaccacagcctccgtaagagcatcggcccgaatagcatgctggcaggggaagacatagaacttcttggacagcaaagggtagcctgaaagaacacaagactcgccaggctcaacaatgacatatcgtttctgctgcgtgtgctcaatttctgttcgaatcttgtccgcagtggcaattgagtccttcatttctcgctggatgttgaccaggttggagttgtaagactccagagagtcacagatagcctgcttaaagtcgtccacaacgacaaagtcggggaataaaggcagaacgtcttcaatcttgagcacctggctctgtttgagaagagaaaccacctgagataagggaatctcgtcggacttgtcagactcctcaatcacatgtttgacaatggcaaaccacaagttcttgcaaagatcaggggtgtaagcggcatcagattcgtccaaatctcgagtctgttcaaccaccttgatggcaagctccagtctgccatggtcaagagcaagcttgactgcctcatggtacatgtgaatgttgcagtagatgtgaacacaggactcgaaccgcttgcatcgaatgcaagtacgaagagcaaaatccacatcatagggcaactgaggaagagtagcacactcgtggagataatccaaaagctcggtctcttcagtctgaggagacatagaaagcaaagaaatgagagtgttgtgaataatagcatcacgagatccctgctttcccacaacatttttcaggtaccgcacagcctggtcactggcaaccttgccaggtctgacagtctgcgagtagttcaacagagcaggaaccattttcgtggggtcaatctcctttcctatcacaatccacgtgtcaacggtatctctgggagcatgcaccagcagaaccgtcgagtatttgtacagcaatgcacggtcttcttcagccttgacctgtcgaagcacctgaagagccttggaccagttctccagaccaacccagtattgcagaacaaagttgtaatcctgaatagctgcagcgtaatatagcagctcctcctgtcggccgttgacgctcatgatctcaaacacggttcccttatgcaaatcgcccttgtatttggtaataaagtcgtggaacttggtcgacaggattcgacgctgctcatccagaggggagtccgaggtggcctcctgatcatccaatttgttgaactgctccataaacaactcgatgatccatgtggacacaagcaggcgttgagtgacattggccttgggaaagacggtcaacttgttctgaaggtacttgagcagtgcctcaggctggttcgcatccaagaacaacaatgcagtctgttccaaggggcgtcttcgcgagtttccataggtgttggctgctccaagatagtccttctcttggatttgcttgtctcccagaatacctagcagttcatcctgagaagagggatcagggtcgttttcagacaaccgcatagcctcgtccagatcaccctgttcgagcaccagcttccacattcctcgagactcatcgtccacagtgatttcgtaaatgttttcagctgagaacaaccaaaaggtgtgttgtttggggtcaactgtgagaccggtaagagtctcattgccctgggtaacatgctgctcaaacaccagctcatgagagaaccgattgacaatatacagcttggtttctgtagcaatggccatatgaaaactggtcagacacatacccacaatagaagattcctggatctggttgagaatgtaaatattggatccttgaaagaaggtcttccgtgactccaaagtgtcattttcgtccttcttgattgttctgtgcacaataccgacctctgaaagcagagcaaaggcccaagatgaggacttggggtcaggaggagtggctgacaacatggcagctcttccgttatcggcaccaaactcctgatctacgtgttcttcacgctcaaagaacttggtgtagacgggaataccgtcctgcaggtgggcagagatcttgccagagtaatagtaggcatgtccattggcgtttgtcacaatgatttttctgtaatttgggctggatccgagctgaacaacgattccggtgatgggtgtcaccacgtggctatcggcagctttgaactcggctaccttgcgcacgtatctgtcttcccgcttgaagtactcgtccgagaactccaagcatgtctcgtagacgcagccgtctgccgttcccagtagcacctctcctgagctcagagagctttcgatgggggaccatgccacgcatgtgattgccaggtctctcaatcggcccagagacttgacctttgtcgtttggtagttgagcacataattgtcgcgggtcttggtggcgatgagtaagtaggagccggtggggtcgagaaacaggttctcaatgtcacatccgccgtccttgacgtccacgtcatccacgctttcggggttgtcgaggtcaattcgaatgattcgcccagacttgagcgccagacagagagtgttgttggccaccgccagagccacgatcgacgagatggcgaactggaactgcacgggctcgaccgcaaacttttcgctttccacagctcggttaggttccgggggaaagtccatgctggtgcgataattacttgtagggctggtgttggtgatgtggagctgagctgtgcatgcagatgtccagcgagcttaatggagggtagttggatggagttccataggacctacaaaatgtgaatacagtatttgtatgaatgctgggaagtagattatctgtagaaacattcatgctgattaacggagatgtgagaattacttctctcatggtcagaaagttgacgatttgctttttccagcatgtttcggcctggcgctatatcatcctggatatctgatctctgtacatggctgattaacgtcagttgatagtcaccttaaaatgtgaacagggggataagacaggccaaaaaattacatacagtataattatacagtagctacttgtacttgtacttgtataattaaatgaatgtatatgcagaaaaaaataaattgtacaatatacagaatgtacagtacaatacatacttatattatgttataaaaattgtacaatatatgatgatactgtatataaataaataaaaaaccaccacgtaaaaacaagacgatataaagacaacaatgtagcccagtaataaaaaaagatggtaatttagaagaatgaaacactgctgaaaaagagatcagacgaattatctaattacaagtgaacataccatagctacaatagtcacaaactggaaccctttttcgttcttcttcgtcaactaatattgacaggaacttgtttatcttgtcataatcacggagagctctttctcaccaataattcggttaaacgaagcttgtacccccaacagtcagccatatatcgcatttcgtagcactcttccctattctaaaagtttagcctcgccaccactcctcgtgtgctacaccaactctatcccgatgaacatttctgcagcaccacacatcacactatgggagctggcggaattccattaaaactcctcagcgaggctcaggtgagtaaagaaaaacagaggaggagttgacatgatgcagcaaatggcgtatgggcacgacttttgtgtcgccacacaccccagaacataactaacacagggtcatgttgtcaccgttgagctcacttcaggacacacttatcggggaaaattgattgaaggtgagtacagaataagggtattgtggcaacttgagggatgtcagcggagtcaggacctcgcttcagcttggtgttgctcgctcgctcagaatctcgcgaagctgggtatccatgtgatattaaattagcaccatgtgattgtgccgcagagaccgaattgttcgtggaggttagacgacagatagggcaagctgctgaacggagcttcaatggagcggtttacgcggaaagatggaccatttgttatgtgtcgctgcattgatggagttgaaatcgaccgtggcttatcagaggacgaccataagcaagcataaacgtttcatttcaacaaacgagatcatgcggctcgcagctgtttctcagaaacctggatatactgccaaacactttccccttagaccaccatactaactcagcggaggataacatgaacgtgcagattcgagacgtgaccgtcactgcgcgaggaggccgagtgtcgcatctcgagcaggtttacatccgaggatcccacgtgcggttcttttccatccccgagatgctgaagaacgcgcccatgtttcggcctcagactctggctgctgtgcgaagcagcagaggccggggcggacggggacgaggaagatgatgtatgtatttgctggttagatgtaatgatgaatgtaaaatagatattgcgagcacgagcacgatagtacgagtacagcacaggtatcggtactgtactgtaacttctgtgggaattttgtctacagtagcaatattgtaggccaagtaaatatggtcatgatagagtaattatcaggctggaagaaaaaacgaaggcgaggggtccgtataatgagggagtacgagaccaaatgggcacgtataatactcttaaggtcttataattcatccattactatttttaagacctcgaatacatctcaaatcatacaaatacattccctaaattttcttcacatttcatctcatctgcaactaattagtggggttaaccctaatggtgtttcttgactgtgtgtcaatcattcatagtccccaaattgctccgaaagcgatatgttttcgttaaataattcactgaaaccaaaaacccaggcttcattaaacaattaatcatttcatcagttcctatacctcctttttctccgtgtcctgtcatctcagcttttccggggcttaagcacacgtaaatacctcccaacaccttaatacgttatcacgcattctggagtcggctacacgactaacacatcaccaaactcgctcccaaaaatgaacaaggcggccatctacgccaagtacaacatctccgaggactatccggagacgtttacggagagcgaaaactttgatctgtcggtgctgcccgaggccgatcctgctcaagagacgaaatcaggagcagcatcagcgtccgtcaacacctctcgatatgtgctgctgaaccagctcgttggcggcaacaaacacagcagacacgccatcaccgacgacgaagccgatccactgggattttcggcctcggtcatgactcaattacgtaaaaagggcgtcgattgcagcgagtctccggccattgctaaccagtactttatctcgtcacgagacttcaatccccgagtgtttctgcgagacgtgcatgcggacgcctctttcgacacccttgctcaatcgttggaccacctggaggcttcaattaccgagcaaagctccgccctgcaaaccctcgtggaccgcaactttgacaagttcgtcaagagtaagagctacctggactcggtattcaagcaattcaagtcgtccgggttcacccaggaaaacgagtggggcatgggagagctgacacagtcgctagatgaaggaaacagcaaagctgcgatcctgatgaatcccgtcttcaacacacgactcaaggaagaacggctacaggctgctctggagatggtgacggccaacagatatctcttcgagctaccctcgacaatcagagcacacatcaaggctggagaccatgagaatctcatgcgagactacaaacgaggcaaggagaccaagaacgaacgtatggcacaggcagagcaactgggagacatgactaccgtccacatgaccgatagaatgtggaacgacgtggaggatatcatcgaggaatacgaaaagtcatgctggacgaaactggaagctgctcctgctggatctcatctccccagtatcagtaggctgctagagcttcaggttaccacaaaccctgtcgtgtactgggtcaagcatcgagctgctgtgattcaacaggagatcaattctacctgcgagaagctcatgctcagtatcactattgctcgaaccgagattctggctcttccagagaataacaccgtgtgggtggagaacattattgaggaggttcgaggccaaccctgtgctcctccaagcacaaagatgtggatcaccgtgaagaagtttgtggtggacatcaatgctctttgtgctcgaattgaggctctgtggaagggaactcgtgactttattgacggtattgcccaacaacagctgcctcccagtgaacacctaaagttttctgaagtcgatgcgcgaactctctatgccagcattggcggtctgatcgaccttgctgctcagcagattggtgagttcttcacccagaagcccaaggtcatgaaccactccaaactagacgcagccgacgtggaaggtggacccgagagctttcaagagacttggaaacggtttggattcctgcctcctcattctaacgctcttaccacctgtaaataccttcctcagcttgttctggacctcgctgtatcttgtgggaacattgtcaacacccgaatccctggccagaacgttgaaaccctgcgtcacgtgctggacttggcccgaacccgatctgttgaagctctttgtgccgtctggaaggacgatacttccaagtttgagctgttggaaaattggaagccgtcccgaaagcagggtaagggtcacgtgacccatgtcccccaaacggtgtttgagtaccagaagcttgtgcttagtggtctcaagaaggtacttttcctcaacacaaacgaccagggccaacgagatgtccaagtggttcttcctcctgctcccaagcttctacaggctctccagacatacttcctctctaccaatcttatgattgtggactccatcatcaagctggtttctggagaagagaactccaagccagatgcgcagttgcaacagcttgccactcgactcaagggtgagatggacgctactgactacatttccgtgcagacttctcccctgcctgctgacaccaagattctgtgggttgtcagtaacctgggagaactaaagaccaacgtcattcctcccctggtcaaacagttccagaaacagtttaacacacaggtcaaatttgactacgacgcgcttacccagagtgaacagaagctcttcagtacctacacagcccccaagaaggccgctctgaccgccgtgatcaaggagggtattcagggcaacaaggagcgatggcccagcaacgccaatcccaccgatatctcaaactacatttacgagtctctgcttttgctggtggttgtgcatgctcagctcatgtctatttctccacagttggtctctcctgttactcatgctcttcagcagcatgcactggagtctctccttgaggctattcgagaagtggagctgtttggaccaggaggcatgtaccaagccgttgccgacattgagttcttccgaaccatcatggcctcctacaacaccaacaatgtacaaaacgtggtgcaacttatttatcaggccattcagcagagttctggtgaccagagcgcctggactggtagacatggaccttgggagaaggtgcagaagctggtgggcgagtgcgccacaagaacttttgtttgtttcagttgtttccgaagctagcactaattttagttgatgtttcttcgacccatctttccaaccacatacatttacaatactgtacgcgaatgggcttaaatactctcggcagccttgtaaaggcattctcatggtgtatttagtggacattttgtcgagtagaaaactgtagagtccttgaatgttgtaattgcagcgtatgtaggggccagactgtctgaatcactgtatgaaagcgatgtcttcaatagccagttgcactttacagctattgttgattctacaggaacacaataccctacctatcactcgtattgctttcatatgaatcgcatctttatcattccgtacacagttcacctctctccctcctaatcctatcatagcatatattgatctaaattactgtactggtgcgtcaacctcttagtttttctcaatgagattggcgtcaaaaacaaggtcaatcaaagtggaagaagaccatgcctgggtgggagaagagtctccacacagctcgccgtccttctgagtgagctcggtgagtccagcccaaggagactcgtggatccactttcggtgttcctccagacgtgaagacagctgctggtagacggagtctcgggcctccttgctgggatgctcgaactgggcgagtccgaaatgcaggaaggctcggaaaaagtagccgatgttccacacccattcaggaccctgatggtagtttcggcccttggaagtggcaaagtcgtcgctgtccacactgttaaggtagtagggtcggtaattgagatcggagggatcaagggtagccataccgacgggacctcgaatggccttgtcagccaccgacaaagcgtgcagagccttgtccacggtgaagagctcgggggcaacagacatggcaatggcaaagttgggtcgaagctggtaatcttcgtagggcttgccagatcggtacagatccttgtagatgcctcgtcggttgacgatagaggagtccacatcgtagtccttgtcctgggaagcctcctcgggcacccagtagcagtgctcaaacgagtcctgcaccttcttctcccagtcgacaaacttgaccttgttgccgtcctggttctccacctcggtccattcaaacagacccttcttgttgagctcgttgacgaaccgcagcgaagacttgagcaggccggcaatctcaatggcagatccatctcgaggagtaccggggtagcccttgttgccagccttggcactctcacccatcttatccatccaggttccacagttccactggttacctccaaagatgagaccgttgctccagtcgacagtgatcttctggttgaaaccctcagacttcatctgcgagtcaatgtcagggccagcattggcctctcggaactcaatgcccttggcgtgacgggtgaagatttcgtagatgacttctcggatggtggaagtggtctggaaggcctccggagagtcgacaggcacgtacttgtcgtccagggggaatcgtcgggtgattttctcgtccagaatcttctctccgtcaggggcaaacttgacgtagtcctggatggcctccaagaagaaccatgtggcatctcgggcattgtatctagggtttctgccagagtcaagtaggttggggatcagaccatgtttgagagttttggcaaaaccgaggatgtgcgacttcacaatgtcgaatcgaccagtgcacagagcaagacctcgaatggagatgaacacatctcggccccaacatcgcatgtagtccacggaaaagtggggcagaccggcagccagggaagcaacgaccttgtcagggaagacagaggcagaagggatctttccaatcatctggatggacgtcagagcaaggttctgcacaaaaatggtcgagtcgctgatagaagagtccagcagagagagcgccttgtttcgcagagcagcataggcagtgtagatgataagggcaaagtatcggggatgcaggaagttgggaagagaagagattcggtcgaaccggctcttgagccacttcttgaaggtggcgacgtcagggtactcctcttcgtacttgcccagacggtctacggtgtagcccatggcccagttgccctgtcgaaggtgctcgcacagaggatgaccaaggttgttatctgccacaattgaaataagaggggacacccaaccctggatgccggcataggtgagctttccgtagccgggaacctcgtagacgccgtcctttccgccagagaaatctcgctcctcggactcggctcggtaaagaaccacgttgaggtctagcaagtcaaagttggacacggcctcgtcggcgccagttcgcacaaactcgtccatctccttgtccacctccacgtagtttgtcttgaagagcgcaatggagcccgcggggaagtcaggaagagtgatagtggtagtgccgttctcaaacttgatatcggcgtctccaagctcctcgaccttggtggggataccaaagatctccttgtcggacttttcggggtctccagtcttgacgagcttcacagcgagtacctgctcggccttggaaccagacagagtaatgggagcaatagtctgctcgggggtgtgctcctcaaacttggttcgagcaaccaggaagtatccatgaccgtcaataggggacagtcggtgcacagtaataaattggccttcgtggtgaatgaaggtctcctcggcatgctttcggccaagctcctcgtgaacagcgtacagctgagccttgatcttcgaaatgccgccatcaaagttgtatgcacgatcctcgcccacaacatcaagcagcttggggtacacctgatcgtagcccatgttggagcccacggaacaggcacacatggcaaccaaagcggcgttgggcagagtgtcctccacagttcgtttctgggcaggggggttgttgtcgtgagtgcagtccatgaacagagcatcgacgttgctctttcgaaccaagttgatgtccagacgatcaccagcaacatcaactctttcaacaccatcctgagtacaatgagccagagactgctcaaagaaggagccaatgggtctaccgccgtgtttgtgaacaagagtggacagctgggcaacgttgtccgcctgcatagcctctcgaatcagagcagtgataccgagacgctcaacgaagattcgatcttcttcctcggagccagtaaacagctcggcaacaacgaagaggttaggtcgcacctttcgagccttgtcaagcagatactggccgacaggaagaggagtggagtgacagttgtcgactcgaacaccatggaagtacttggcacaagtctgcacgtacgtggccatgtggtcccacagccagggcgagtcctcaggcttcttaccgtatcgaagcttgacgcaatcgccccaaatgatcacctgtcgaagcaaataggccttcgacttgttggaagcgaagtcaactagagggttggctccccacatccatccattgttggccagatgcagcttcttgccgtccttggaggtgattcgggtgtagtaagtctccaccagaggggacttcttagacacctcctggccatgctgaggtccattctcgtccagtcgagtgtacgaaactcggttcttcacctggtccagaatgg

(The sequence listing continues in the following parts.)

The invention claimed is:

1. A non-naturally occurring or engineered composition comprising a CRISPR-Cas system comprising guide-polynucleotide and a Cas protein, wherein the guide-polynucleotide comprises a guide-sequence that is the reverse complement of a target-polynucleotide sequence in a host cell, which host cell is a *Yarrowia lipolytic* yeast, wherein the guide-polynucleotide directs binding of the Cas protein at the target-polynucleotide in the host cell to form a CRISPR-Cas complex, wherein the guide-polynucleotide sequence is the reverse complement of the (N)y part of a 5'-(N)yPAM-3' polynucleotide sequence target in the genome of the host cell, wherein y is an integer of 8-30, wherein PAM is a protospacer adjacent motif, wherein PAM is a sequence selected from the group consisting of 5'-XGG-3', 5'-XGGXG-3', 5'-XXAGAAW-3', 5'-XXXXGATT-3', 5'-XXAGAA-3', 5'-XAAAAC-3', wherein X can be any nucleotide; and W is A or T, wherein the guide-polynucleotide is encoded by a polynucleotide that is operably linked to an RNA polymerase II promoter, wherein the polynucleotide that is operably linked to an RNA polymerase II promoter further encodes a pre-guide polynucleotide comprising the guide-polynucleotide and at least one self-processing ribozyme, wherein, when transcribed, the guide-polynucleotide is released by the self-processing ribozyme from the pre-guide-polynucleotide transcript.

2. A composition according to claim 1, wherein the Cas protein is encoded by a polynucleotide.

3. A composition according to claim 2, wherein the polynucleotides encoding the guide-polynucleotides and the polynucleotide encoding the Cas protein are comprised in one vector.

4. A composition according to claim 3, wherein the vector is linear.

5. A composition according to claim 4, comprising at least two distinct polynucleotides each encoding a distinct guide-polynucleotide, wherein said at least two polynucleotides additionally comprise sequence identity with each other such that recombination of the polynucleotides encoding the distinct guide-polynucleotides and said vector is facilitated, wherein the recombination optionally is in vivo recombination in the host cell.

6. A composition according to claim 2, wherein the polynucleotide encoding the guide-polynucleotide and the polynucleotide encoding the Cas protein are comprised in separate vectors.

7. A composition according to claim 6, the vector comprising the polynucleotide encoding the Cas protein is a low copy number vector and the vector comprising the polynucleotide encoding the guide-polynucleotide is a high copy number vector.

8. A composition according to claim 7, wherein one or more or vectors comprise a selectable marker, optionally, wherein each vector comprises a distinct selectable marker.

9. A composition according to claim 1, further comprising one or more distinct exogenous polynucleotides that upon cleavage of the target-polynucleotide by the CRISPR-Cas complex recombines with the target-polynucleotide, resulting in a modified target-polynucleotide.

10. A composition according to claim 9, wherein at least two distinct exogenous polynucleotides are present that upon cleavage of the target-polynucleotide by the CRISPR-Cas complex recombine with the target-polynucleotides, resulting in a modified target-polynucleotide, wherein said at least two distinct exogenous polynucleotides comprise sequence identity with each other such that recombination of said distinct exogenous polynucleotides is facilitated, wherein the recombination optionally is in vivo recombination in the host cell.

11. A composition according to claim 9, wherein a further and distinct exogenous polynucleotide is present that upon cleavage of the target-polynucleotide by the CRISPR-Cas complex recombines with the target-polynucleotide, resulting in a modified target-polynucleotide, wherein an additional polynucleotide is present that has sequence identity with the exogenous and distinct polynucleotides such that recombination of the exogenous and distinct polynucleotides is facilitated, and wherein the recombination optionally is in vivo recombination in the host cell.

12. A composition according to claim 9, wherein one or more exogenous polynucleotides are operably linked to the guide-polynucleotide.

13. A composition according to claim 3, wherein the vector is an autonomously replicating vector.

14. A composition according to claim 1, wherein the Cas protein comprises at least one nuclear localization sequence, optionally a heterologous nuclear localization sequence.

15. A composition according to claim 1, wherein the Cas protein has activity for directing cleavage of both polynucleotide strands at the location of the target-sequence.

16. A composition according to claim 1, wherein the Cas protein comprises at least one mutation, such that the protein has altered nuclease activity compared to the corresponding wild-type Cas protein, optionally having activity to direct cleavage of a single polynucleotide strand at the location of the target-sequence.

17. A composition according to claim 1, wherein the Cas protein encoding polynucleotide is codon optimized for the host cell, optionally codon pair optimized.

18. A host cell comprising a composition according to claim 1.

19. The composition according to claim 1, wherein the *Yarrowia* is *Yarrowia lipolytica* deposited under number ATCC18943.

* * * * *